(12) United States Patent
Crawford et al.

(10) Patent No.: US 10,378,012 B2
(45) Date of Patent: Aug. 13, 2019

(54) COMPOSITIONS AND METHODS FOR CONTROLLING INSECT PESTS

(71) Applicant: MONSANTO TECHNOLOGY LLC, St. Louis, MO (US)

(72) Inventors: Michael John Crawford, St. Louis, MO (US); Brian Donovan Eads, St. Louis, MO (US)

(73) Assignee: MONSANTO TECHNOLOGY LLC, St. Louis, MO (US)

( * ) Notice: Subject to any disclaimer, the term of this patent is extended or adjusted under 35 U.S.C. 154(b) by 0 days.

(21) Appl. No.: 15/329,808

(22) PCT Filed: Jul. 28, 2015

(86) PCT No.: PCT/US2015/042415
§ 371 (c)(1),
(2) Date: Jan. 27, 2017

(87) PCT Pub. No.: WO2016/018887
PCT Pub. Date: Feb. 4, 2016

(65) Prior Publication Data
US 2017/0260522 A1    Sep. 14, 2017

Related U.S. Application Data

(60) Provisional application No. 62/030,430, filed on Jul. 29, 2014.

(51) Int. Cl.
| C12N 15/82 | (2006.01) |
| C12N 15/113 | (2010.01) |
| C12N 15/11 | (2006.01) |
| A01N 57/16 | (2006.01) |
| A01N 63/02 | (2006.01) |

(52) U.S. Cl.
CPC ............ *C12N 15/113* (2013.01); *A01N 57/16* (2013.01); *A01N 63/02* (2013.01); *C12N 15/111* (2013.01); *C12N 15/8286* (2013.01); *C12N 2310/14* (2013.01); *Y02A 40/162* (2018.01)

(58) Field of Classification Search
CPC .................................................. C12N 15/113
USPC .......................................................... 800/279
See application file for complete search history.

(56) References Cited

U.S. PATENT DOCUMENTS

| 3,687,808 A | 8/1972 | Merigan et al. |
| 3,791,932 A | 2/1974 | Schuurs et al. |
| 3,839,153 A | 10/1974 | Schuurs et al. |
| 3,850,578 A | 11/1974 | McConnell |
| 3,850,752 A | 11/1974 | Schuurs et al. |
| 3,853,987 A | 12/1974 | Dreyer |
| 3,867,517 A | 2/1975 | Ling |
| 3,879,262 A | 4/1975 | Schuurs et al. |
| 3,901,654 A | 8/1975 | Gross |
| 3,935,074 A | 1/1976 | Rubenstein et al. |
| 3,984,533 A | 10/1976 | Uzgiris |
| 3,996,345 A | 12/1976 | Ullman et al. |
| 4,034,074 A | 7/1977 | Miles |
| 4,098,876 A | 7/1978 | Piasio et al. |
| 4,469,863 A | 9/1984 | Ts'o et al. |
| 4,476,301 A | 10/1984 | Imbach et al. |
| 4,535,060 A | 8/1985 | Comai |
| 4,581,847 A | 4/1986 | Hibberd et al. |
| 4,666,828 A | 5/1987 | Gusella |
| 4,683,202 A | 7/1987 | Mullis |
| 4,732,250 A | 3/1988 | Maucher et al. |
| 4,761,373 A | 8/1988 | Anderson et al. |
| 4,769,061 A | 9/1988 | Comai |
| 4,801,531 A | 1/1989 | Frossard |
| 4,810,648 A | 3/1989 | Stalker |
| 4,879,219 A | 11/1989 | Wands et al. |
| 4,940,835 A | 7/1990 | Shah et al. |
| 4,971,908 A | 11/1990 | Kishore et al. |
| 5,004,863 A | 4/1991 | Umbeck |
| 5,011,771 A | 4/1991 | Bellet et al. |
| 5,013,659 A | 5/1991 | Bedbrook et al. |
| 5,015,580 A | 5/1991 | Christou et al. |
| 5,023,243 A | 6/1991 | Tullis |
| 5,034,506 A | 7/1991 | Summerton et al. |
| 5,094,945 A | 3/1992 | Comai |
| 5,141,870 A | 8/1992 | Bedbrook et al. |
| 5,145,783 A | 9/1992 | Kishore et al. |
| 5,159,135 A | 10/1992 | Umbeck |
| 5,166,315 A | 11/1992 | Summerton et al. |
| 5,177,196 A | 1/1993 | Meyer, Jr. et al. |
| 5,185,444 A | 2/1993 | Summerton et al. |
| 5,188,642 A | 2/1993 | Shah et al. |
| 5,188,897 A | 2/1993 | Suhadolnik et al. |
| 5,192,659 A | 3/1993 | Simons |
| 5,214,134 A | 5/1993 | Weis et al. |
| 5,216,141 A | 6/1993 | Benner |
| 5,235,033 A | 8/1993 | Summerton et al. |
| 5,264,423 A | 11/1993 | Cohen et al. |
| 5,264,562 A | 11/1993 | Matteucci |
| 5,264,564 A | 11/1993 | Matteucci |
| 5,272,057 A | 12/1993 | Smulson et al. |

(Continued)

FOREIGN PATENT DOCUMENTS

| AU | 2008325989 A1 | 5/2009 |
| AU | 2008258254 B2 | 7/2014 |

(Continued)

OTHER PUBLICATIONS

Thomas et al. 2001, The Plant Journal 25(4):417-425.*

(Continued)

*Primary Examiner* — Li Zheng
(74) *Attorney, Agent, or Firm* — Amanda Carmany-Rampey; David R. Marsh; Arnold & Porter Kaye Scholer LLP

(57) ABSTRACT

Disclosed herein are polynucleotides, compositions, and methods for controlling insect pests, especially flea beetles, such as *Phyllotreta* spp. and *Psylliodes* spp., particularly in plants. More specifically, polynucleotides such as double-stranded RNA triggers and methods of use thereof for modifying the expression of genes in flea beetles.

16 Claims, No Drawings

Specification includes a Sequence Listing.

(56) References Cited

U.S. PATENT DOCUMENTS

| | | |
|---|---|---|
| 5,276,019 A | 1/1994 | Cohen et al. |
| 5,278,302 A | 1/1994 | Caruthers et al. |
| 5,281,521 A | 1/1994 | Trojanowski et al. |
| 5,286,634 A | 2/1994 | Stadler et al. |
| 5,286,717 A | 2/1994 | Cohen et al. |
| 5,304,732 A | 4/1994 | Anderson et al. |
| 5,310,667 A | 5/1994 | Eichholtz et al. |
| 5,312,910 A | 5/1994 | Kishore et al. |
| 5,321,131 A | 6/1994 | Agrawal et al. |
| 5,331,107 A | 7/1994 | Anderson et al. |
| 5,339,107 A | 8/1994 | Henry et al. |
| 5,346,107 A | 9/1994 | Bouix et al. |
| 5,378,824 A | 1/1995 | Bedbrook et al. |
| 5,390,667 A | 2/1995 | Kumakura et al. |
| 5,392,910 A | 2/1995 | Bell et al. |
| 5,393,175 A | 2/1995 | Courville |
| 5,399,676 A | 3/1995 | Froehler |
| 5,405,938 A | 4/1995 | Summerton et al. |
| 5,405,939 A | 4/1995 | Suhadolnik et al. |
| 5,416,011 A | 5/1995 | Hinchee et al. |
| 5,453,496 A | 9/1995 | Caruthers et al. |
| 5,455,233 A | 10/1995 | Spielvogel et al. |
| 5,459,127 A | 10/1995 | Felgner et al. |
| 5,460,667 A | 10/1995 | Moriyuki et al. |
| 5,462,910 A | 10/1995 | Ito et al. |
| 5,463,174 A | 10/1995 | Moloney et al. |
| 5,463,175 A | 10/1995 | Barry et al. |
| 5,466,677 A | 11/1995 | Baxter et al. |
| 5,470,967 A | 11/1995 | Huie et al. |
| 5,476,925 A | 12/1995 | Letsinger et al. |
| 5,489,520 A | 2/1996 | Adams et al. |
| 5,489,677 A | 2/1996 | Sanghvi et al. |
| 5,491,288 A | 2/1996 | Chaubet et al. |
| 5,510,471 A | 4/1996 | Lebrun et al. |
| 5,518,908 A | 5/1996 | Corbin et al. |
| 5,519,126 A | 5/1996 | Hecht |
| 5,536,821 A | 7/1996 | Agrawal et al. |
| 5,538,880 A | 7/1996 | Lundquist et al. |
| 5,539,082 A | 7/1996 | Nielsen et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,550,318 A | 8/1996 | Adams et al. |
| 5,550,398 A | 8/1996 | Kocian et al. |
| 5,550,468 A | 8/1996 | Häberlein et al. |
| 5,558,071 A | 9/1996 | Ward et al. |
| 5,561,225 A | 10/1996 | Maddry et al. |
| 5,561,236 A | 10/1996 | Leemans et al. |
| 5,563,253 A | 10/1996 | Agrawal et al. |
| 5,569,834 A | 10/1996 | Hinchee et al. |
| 5,571,799 A | 11/1996 | Tkachuk et al. |
| 5,587,361 A | 12/1996 | Cook et al. |
| 5,591,616 A | 1/1997 | Hiei et al. |
| 5,593,874 A | 1/1997 | Brown et al. |
| 5,596,086 A | 1/1997 | Matteucci et al. |
| 5,597,717 A | 1/1997 | Guerineau et al. |
| 5,602,240 A | 2/1997 | De Mesmaeker et al. |
| 5,605,011 A | 2/1997 | Bedbrook et al. |
| 5,608,046 A | 3/1997 | Cook et al. |
| 5,610,289 A | 3/1997 | Cook et al. |
| 5,618,704 A | 4/1997 | Sanghvi et al. |
| 5,623,070 A | 4/1997 | Cook et al. |
| 5,625,050 A | 4/1997 | Beaton et al. |
| 5,627,061 A | 5/1997 | Barry et al. |
| 5,633,360 A | 5/1997 | Bischofberger et al. |
| 5,633,435 A | 5/1997 | Barry et al. |
| 5,633,448 A | 5/1997 | Lebrun et al. |
| 5,639,024 A | 6/1997 | Mueller et al. |
| 5,646,024 A | 7/1997 | Leemans et al. |
| 5,648,477 A | 7/1997 | Leemans et al. |
| 5,663,312 A | 9/1997 | Chaturvedula |
| 5,677,437 A | 10/1997 | Teng et al. |
| 5,677,439 A | 10/1997 | Weis et al. |
| 5,714,331 A | 2/1998 | Buchardt et al. |
| 5,719,046 A | 2/1998 | Guerineau et al. |
| 5,719,262 A | 2/1998 | Buchardt et al. |
| 5,721,138 A | 2/1998 | Lawn |
| 5,731,180 A | 3/1998 | Dietrich |
| 5,739,180 A | 4/1998 | Taylor-Smith |
| 5,746,180 A | 5/1998 | Jefferson et al. |
| 5,767,361 A | 6/1998 | Dietrich |
| 5,767,373 A | 6/1998 | Ward et al. |
| 5,780,708 A | 7/1998 | Lundquist et al. |
| 5,804,425 A | 9/1998 | Barry et al. |
| 5,824,877 A | 10/1998 | Hinchee et al. |
| 5,837,848 A | 11/1998 | Ely et al. |
| 5,859,347 A | 1/1999 | Brown et al. |
| 5,866,775 A | 2/1999 | Eichholtz et al. |
| 5,874,265 A | 2/1999 | Adams et al. |
| 5,879,903 A | 3/1999 | Strauch et al. |
| 5,898,031 A | 4/1999 | Crooke |
| 5,914,451 A | 6/1999 | Martinell et al. |
| 5,919,675 A | 7/1999 | Adams et al. |
| 5,928,937 A | 7/1999 | Kakefuda et al. |
| 5,939,602 A | 8/1999 | Volrath et al. |
| 5,969,213 A | 10/1999 | Adams et al. |
| 5,981,840 A | 11/1999 | Zhao et al. |
| 5,985,793 A | 11/1999 | Sandbrink et al. |
| RE36,449 E | 12/1999 | Lebrun et al. |
| 6,040,497 A | 3/2000 | Spencer et al. |
| 6,056,938 A | 5/2000 | Unger et al. |
| 6,069,115 A | 5/2000 | Pallett et al. |
| 6,084,089 A | 7/2000 | Mine et al. |
| 6,084,155 A | 7/2000 | Volrath et al. |
| 6,107,094 A | 8/2000 | Crooke |
| 6,118,047 A | 9/2000 | Anderson et al. |
| 6,121,513 A | 9/2000 | Zhang et al. |
| 6,130,366 A | 10/2000 | Herrera-Estrella et al. |
| 6,140,078 A | 10/2000 | Sanders et al. |
| 6,153,812 A | 11/2000 | Fry et al. |
| 6,160,208 A | 12/2000 | Lundquist et al. |
| 6,177,616 B1 | 1/2001 | Bartsch et al. |
| 6,194,636 B1 | 2/2001 | McElroy et al. |
| 6,225,105 B1 | 5/2001 | Sathasivan et al. |
| 6,225,114 B1 | 5/2001 | Eichholtz et al. |
| 6,232,526 B1 | 5/2001 | McElroy et al. |
| 6,232,536 B1 | 5/2001 | McElroy et al. |
| 6,245,968 B1 | 6/2001 | Boudec et al. |
| 6,248,876 B1 | 6/2001 | Barry et al. |
| 6,252,138 B1 | 6/2001 | Karimi et al. |
| RE37,287 E | 7/2001 | Lebrun et al. |
| 6,268,549 B1 | 7/2001 | Sailland et al. |
| 6,271,359 B1 | 8/2001 | Norris et al. |
| 6,282,837 B1 | 9/2001 | Ward et al. |
| 6,288,306 B1 | 9/2001 | Ward et al. |
| 6,288,312 B1 | 9/2001 | Christou et al. |
| 6,294,714 B1 | 9/2001 | Matsunaga et al. |
| 6,303,374 B1 | 10/2001 | Zhang et al. |
| 6,326,193 B1 | 12/2001 | Liu et al. |
| 6,329,571 B1 | 12/2001 | Hiei |
| 6,348,185 B1 | 2/2002 | Piwnica-Worms |
| 6,365,807 B1 | 4/2002 | Christou et al. |
| 6,384,301 B1 | 5/2002 | Martinell et al. |
| 6,385,902 B1 | 5/2002 | Schipper et al. |
| 6,399,861 B1 | 6/2002 | Anderson et al. |
| 6,403,865 B1 | 6/2002 | Koziel et al. |
| 6,414,222 B1 | 7/2002 | Gengenbach et al. |
| 6,421,956 B1 | 7/2002 | Boukens et al. |
| 6,426,446 B1 | 7/2002 | McElroy et al. |
| 6,433,252 B1 | 8/2002 | Kriz et al. |
| 6,437,217 B1 | 8/2002 | McElroy et al. |
| 6,453,609 B1 | 9/2002 | Soll et al. |
| 6,479,291 B2 | 11/2002 | Kumagai et al. |
| 6,506,559 B1 | 1/2003 | Fire et al. |
| 6,642,435 B1 | 11/2003 | Rafalski et al. |
| 6,644,341 B1 | 11/2003 | Chemo et al. |
| 6,645,914 B1 | 11/2003 | Woznica et al. |
| 6,768,044 B1 | 7/2004 | Boudec et al. |
| 6,843,985 B2 | 1/2005 | Erickson, Jr. et al. |
| 6,992,237 B1 | 1/2006 | Habben et al. |
| 7,022,896 B1 | 4/2006 | Weeks et al. |
| 7,026,528 B2 | 4/2006 | Cheng et al. |
| 7,056,704 B2 | 6/2006 | Tuschl et al. |
| 7,078,196 B2 | 7/2006 | Tuschl et al. |

(56) References Cited

U.S. PATENT DOCUMENTS

| | | |
|---|---|---|
| RE39,247 E | 8/2006 | Barry et al. |
| 7,105,724 B2 | 9/2006 | Weeks et al. |
| 7,297,541 B2 | 11/2007 | Moshiri et al. |
| 7,304,209 B2 | 12/2007 | Zink et al. |
| 7,312,379 B2 | 12/2007 | Andrews et al. |
| 7,323,310 B2 | 1/2008 | Peters et al. |
| 7,371,927 B2 | 5/2008 | Yao et al. |
| 7,392,379 B2 | 6/2008 | Le Pennec et al. |
| 7,405,347 B2 | 7/2008 | Hammer et al. |
| 7,406,981 B2 | 8/2008 | Hemo et al. |
| 7,462,379 B2 | 12/2008 | Fukuda et al. |
| 7,485,777 B2 | 2/2009 | Nakajima et al. |
| 7,525,013 B2 | 4/2009 | Hildebrand et al. |
| 7,550,578 B2 | 6/2009 | Budworth et al. |
| 7,622,301 B2 | 11/2009 | Ren et al. |
| 7,657,299 B2 | 2/2010 | Huizenga et al. |
| 7,671,254 B2 | 3/2010 | Tranel et al. |
| 7,714,188 B2 | 5/2010 | Castle et al. |
| 7,738,626 B2 | 6/2010 | Weese et al. |
| 7,807,791 B2 | 10/2010 | Sekar et al. |
| 7,838,263 B2 | 11/2010 | Dam et al. |
| 7,838,733 B2 | 11/2010 | Wright et al. |
| 7,842,856 B2 | 11/2010 | Tranel et al. |
| 7,855,323 B2 | 12/2010 | Huang et al. |
| 7,884,262 B2 | 2/2011 | Clemente et al. |
| 7,910,805 B2 | 3/2011 | Duck et al. |
| 7,935,869 B2 | 5/2011 | Pallett et al. |
| 7,943,819 B2 | 5/2011 | Baum et al. |
| 7,973,218 B2 | 7/2011 | McCutchen et al. |
| 8,090,164 B2 | 1/2012 | Bullitt et al. |
| 8,097,712 B2 | 1/2012 | Paldi et al. |
| 8,143,480 B2 | 3/2012 | Axtell et al. |
| 8,158,414 B2 | 4/2012 | Rommens et al. |
| 8,507,457 B2 | 8/2013 | Paldi et al. |
| 8,548,778 B1 | 10/2013 | Hart et al. |
| 8,554,490 B2 | 10/2013 | Tang et al. |
| 8,598,332 B1 | 12/2013 | Waterhouse et al. |
| 9,006,414 B2 | 4/2015 | Huang et al. |
| 9,121,022 B2 | 9/2015 | Sammons et al. |
| 9,422,557 B2 | 8/2016 | Ader |
| 9,445,603 B2 | 9/2016 | Baum et al. |
| 2001/0006797 A1 | 7/2001 | Kumagai et al. |
| 2001/0042257 A1 | 11/2001 | Connor-Ward et al. |
| 2002/0069430 A1 | 6/2002 | Kiaska et al. |
| 2002/0086356 A1 | 7/2002 | Tuschl et al. |
| 2002/0114784 A1 | 8/2002 | Li et al. |
| 2002/0123476 A1 | 9/2002 | Emanuele et al. |
| 2003/0017068 A1 | 1/2003 | Larrain et al. |
| 2003/0044443 A1 | 3/2003 | Erickson, Jr. et al. |
| 2003/0092651 A1 | 5/2003 | Norris et al. |
| 2003/0096980 A1 | 5/2003 | Froehler et al. |
| 2003/0140371 A1 | 7/2003 | Stevens et al. |
| 2003/0150017 A1 | 8/2003 | Mesa et al. |
| 2003/0154508 A1 | 8/2003 | Stevens et al. |
| 2003/0167537 A1 | 9/2003 | Jiang |
| 2003/0180945 A1 | 9/2003 | Wang et al. |
| 2004/0029275 A1 | 2/2004 | Brown et al. |
| 2004/0053289 A1 | 3/2004 | Allen et al. |
| 2004/0055041 A1 | 3/2004 | Labate et al. |
| 2004/0072692 A1 | 4/2004 | Hoffman et al. |
| 2004/0082475 A1 | 4/2004 | Hoffman et al. |
| 2004/0123347 A1 | 6/2004 | Hinchey et al. |
| 2004/0126845 A1 | 7/2004 | Eenennaam et al. |
| 2004/0133944 A1 | 7/2004 | Hake et al. |
| 2004/0147475 A1 | 7/2004 | Li et al. |
| 2004/0177399 A1 | 9/2004 | Hammer et al. |
| 2004/0216189 A1 | 10/2004 | Houmard et al. |
| 2004/0244075 A1 | 12/2004 | Cai et al. |
| 2004/0250310 A1 | 12/2004 | Shukla et al. |
| 2004/0259247 A1 | 12/2004 | Tuschl et al. |
| 2005/0005319 A1 | 1/2005 | della-Cioppa et al. |
| 2005/0044591 A1 | 2/2005 | Yao et al. |
| 2005/0080032 A1 | 4/2005 | Gross et al. |
| 2005/0095199 A1 | 5/2005 | Whyard et al. |
| 2005/0215435 A1 | 9/2005 | Menges et al. |
| 2005/0250647 A1 | 11/2005 | Hills et al. |
| 2006/0009358 A1 | 1/2006 | Kibler et al. |
| 2006/0021087 A1 | 1/2006 | Baum et al. |
| 2006/0040826 A1 | 2/2006 | Eaton et al. |
| 2006/0111241 A1 | 5/2006 | Gerwick, III et al. |
| 2006/0130172 A1 | 6/2006 | Whaley et al. |
| 2006/0135758 A1 | 6/2006 | Wu |
| 2006/0200878 A1 | 9/2006 | Lutfiyya et al. |
| 2006/0223708 A1 | 10/2006 | Hoffman et al. |
| 2006/0223709 A1 | 10/2006 | Helmke et al. |
| 2006/0247197 A1 | 11/2006 | Van De Craen et al. |
| 2006/0272049 A1* | 11/2006 | Waterhouse ..... C07K 14/43563 800/279 |
| 2006/0276339 A1 | 12/2006 | Windsor et al. |
| 2007/0011448 A1 | 1/2007 | Chhabra et al. |
| 2007/0011775 A1 | 1/2007 | Allen et al. |
| 2007/0021360 A1 | 1/2007 | Nyce et al. |
| 2007/0050860 A1 | 3/2007 | Andersen et al. |
| 2007/0050863 A1 | 3/2007 | Tranel et al. |
| 2007/0124836 A1 | 5/2007 | Baum et al. |
| 2007/0199095 A1 | 8/2007 | Allen et al. |
| 2007/0219151 A1 | 9/2007 | Satishchandran et al. |
| 2007/0232188 A1 | 10/2007 | Probasco |
| 2007/0250947 A1 | 10/2007 | Boukharov et al. |
| 2007/0259785 A1 | 11/2007 | Heck et al. |
| 2007/0269815 A1 | 11/2007 | Rivory et al. |
| 2007/0281900 A1 | 12/2007 | Cui et al. |
| 2007/0300329 A1 | 12/2007 | Allen et al. |
| 2008/0022423 A1 | 1/2008 | Roberts et al. |
| 2008/0050342 A1 | 2/2008 | Fire et al. |
| 2008/0092256 A1 | 4/2008 | Kohn |
| 2008/0113351 A1 | 5/2008 | Naito et al. |
| 2008/0155716 A1 | 6/2008 | Sonnewald et al. |
| 2008/0194512 A1 | 8/2008 | John et al. |
| 2008/0214443 A1 | 9/2008 | Baum et al. |
| 2008/0261303 A1 | 10/2008 | Kreutzer et al. |
| 2009/0011934 A1 | 1/2009 | Zawierucha et al. |
| 2009/0018016 A1 | 1/2009 | Duck et al. |
| 2009/0036311 A1 | 2/2009 | Witschel et al. |
| 2009/0054240 A1 | 2/2009 | Witschel et al. |
| 2009/0075921 A1 | 3/2009 | Ikegawa et al. |
| 2009/0098614 A1 | 4/2009 | Zamore et al. |
| 2009/0118214 A1 | 5/2009 | Paldi et al. |
| 2009/0137395 A1 | 5/2009 | Chicoine et al. |
| 2009/0165153 A1 | 6/2009 | Wang et al. |
| 2009/0165166 A1 | 6/2009 | Feng et al. |
| 2009/0172838 A1 | 7/2009 | Axtell et al. |
| 2009/0188005 A1 | 7/2009 | Boukharov et al. |
| 2009/0205079 A1 | 8/2009 | Kumar et al. |
| 2009/0215628 A1 | 8/2009 | Witschel et al. |
| 2009/0285784 A1 | 11/2009 | Raemaekers et al. |
| 2009/0293148 A1 | 11/2009 | Ren et al. |
| 2009/0298787 A1 | 12/2009 | Raemaekers et al. |
| 2009/0306189 A1 | 12/2009 | Raemaekers et al. |
| 2009/0307803 A1 | 12/2009 | Baum et al. |
| 2010/0005551 A1 | 1/2010 | Roberts et al. |
| 2010/0048670 A1 | 2/2010 | Biard et al. |
| 2010/0068172 A1 | 3/2010 | Van De Craen |
| 2010/0071088 A1 | 3/2010 | Sela et al. |
| 2010/0099561 A1 | 4/2010 | Selby et al. |
| 2010/0100988 A1 | 4/2010 | Tranel et al. |
| 2010/0152443 A1 | 6/2010 | Hirai et al. |
| 2010/0154083 A1 | 6/2010 | Ross et al. |
| 2010/0192237 A1 | 7/2010 | Ren et al. |
| 2010/0247578 A1 | 9/2010 | Salama |
| 2011/0015084 A1 | 1/2011 | Christian et al. |
| 2011/0015284 A1 | 1/2011 | Dees et al. |
| 2011/0028412 A1 | 2/2011 | Cappello et al. |
| 2011/0035836 A1 | 2/2011 | Eudes et al. |
| 2011/0041400 A1 | 2/2011 | Trias Vila et al. |
| 2011/0053226 A1 | 3/2011 | Rohayem |
| 2011/0098180 A1 | 4/2011 | Michel et al. |
| 2011/0105327 A1 | 5/2011 | Nelson |
| 2011/0105329 A1 | 5/2011 | Song et al. |
| 2011/0112570 A1 | 5/2011 | Mannava et al. |
| 2011/0126310 A1 | 5/2011 | Feng et al. |
| 2011/0126311 A1 | 5/2011 | Velcheva et al. |
| 2011/0152339 A1 | 6/2011 | Brown et al. |
| 2011/0152346 A1 | 6/2011 | Karleson et al. |

(56) References Cited

U.S. PATENT DOCUMENTS

| | | |
|---|---|---|
| 2011/0152353 A1 | 6/2011 | Koizumi et al. |
| 2011/0160082 A1 | 6/2011 | Woo et al. |
| 2011/0166022 A1 | 7/2011 | Israels et al. |
| 2011/0166023 A1 | 7/2011 | Nettleton-Hammond et al. |
| 2011/0171176 A1 | 7/2011 | Baas et al. |
| 2011/0171287 A1 | 7/2011 | Saarma et al. |
| 2011/0177949 A1 | 7/2011 | Krapp et al. |
| 2011/0185444 A1 | 7/2011 | Li et al. |
| 2011/0185445 A1 | 7/2011 | Bogner et al. |
| 2011/0191897 A1 | 8/2011 | Poree et al. |
| 2011/0201501 A1 | 8/2011 | Song et al. |
| 2011/0296555 A1 | 12/2011 | Ivashuta et al. |
| 2011/0296556 A1 | 12/2011 | Sammons et al. |
| 2012/0036594 A1 | 2/2012 | Cardoza et al. |
| 2012/0053231 A1 | 3/2012 | Paldi et al. |
| 2012/0107355 A1 | 5/2012 | Harris et al. |
| 2012/0108497 A1 | 5/2012 | Paldi et al. |
| 2012/0128218 A1 | 5/2012 | Amyot et al. |
| 2012/0137387 A1 | 5/2012 | Baum et al. |
| 2012/0150048 A1 | 6/2012 | Kang et al. |
| 2012/0156784 A1 | 6/2012 | Adams, Jr. et al. |
| 2012/0157512 A1 | 6/2012 | Ben-Chanoch et al. |
| 2012/0164205 A1 | 6/2012 | Baum et al. |
| 2012/0185967 A1 | 7/2012 | Sela et al. |
| 2012/0198586 A1 | 8/2012 | Narva et al. |
| 2012/0230565 A1 | 9/2012 | Steinberg et al. |
| 2012/0258646 A1 | 10/2012 | Sela et al. |
| 2012/0316220 A1 | 12/2012 | Ward et al. |
| 2013/0003213 A1 | 1/2013 | Kabelac et al. |
| 2013/0041004 A1 | 2/2013 | Drager et al. |
| 2013/0047297 A1 | 2/2013 | Sammons et al. |
| 2013/0047298 A1 | 2/2013 | Tang |
| 2013/0058890 A1 | 3/2013 | Raemaekers et al. |
| 2013/0060133 A1 | 3/2013 | Kassab et al. |
| 2013/0067618 A1 | 3/2013 | Ader et al. |
| 2013/0084243 A1 | 4/2013 | Goetsch et al. |
| 2013/0096073 A1 | 4/2013 | Sidelman |
| 2013/0097726 A1 | 4/2013 | Ader et al. |
| 2013/0212739 A1 | 8/2013 | Giritch et al. |
| 2013/0226003 A1 | 8/2013 | Edic et al. |
| 2013/0232646 A1 | 9/2013 | Baum et al. |
| 2013/0247247 A1 | 9/2013 | Ader et al. |
| 2013/0254940 A1 | 9/2013 | Ader et al. |
| 2013/0254941 A1 | 9/2013 | Ader et al. |
| 2013/0288895 A1 | 10/2013 | Ader et al. |
| 2013/0289097 A1 | 10/2013 | Paldi et al. |
| 2013/0318657 A1 | 11/2013 | Avniel et al. |
| 2013/0318658 A1 | 11/2013 | Ader et al. |
| 2013/0324842 A1 | 12/2013 | Mittal et al. |
| 2013/0326731 A1 | 12/2013 | Ader et al. |
| 2014/0018241 A1 | 1/2014 | Sammons et al. |
| 2014/0057789 A1 | 2/2014 | Sammons et al. |
| 2014/0109258 A1 | 4/2014 | Van De Craen et al. |
| 2014/0230090 A1 | 8/2014 | Avniel et al. |
| 2014/0274712 A1 | 9/2014 | Finnessy et al. |
| 2014/0275208 A1 | 9/2014 | Hu et al. |
| 2014/0296503 A1 | 10/2014 | Avniel et al. |
| 2014/0371298 A1 | 12/2014 | Paldi et al. |
| 2015/0096079 A1 | 4/2015 | Avniel et al. |
| 2015/0143580 A1 | 5/2015 | Beattie et al. |
| 2015/0159156 A1 | 6/2015 | Inberg et al. |
| 2015/0203867 A1 | 7/2015 | Beattie et al. |
| 2015/0240258 A1 | 8/2015 | Beattie et al. |
| 2016/0015035 A1 | 1/2016 | Tao |
| 2016/0029644 A1 | 2/2016 | Tao |
| 2017/0037407 A1 | 2/2017 | Gleit-Kielmanowicz et al. |
| 2017/0088838 A1 | 3/2017 | Inberg et al. |
| 2017/0183683 A1 | 6/2017 | Zheng et al. |

FOREIGN PATENT DOCUMENTS

| | | |
|---|---|---|
| CA | 2806295 A1 | 2/2011 |
| CN | 1505504 A | 6/2004 |
| CN | 101139607 A | 3/2008 |
| CN | 101279950 A | 10/2008 |
| CN | 101279951 A | 10/2008 |
| CN | 101914540 A | 12/2010 |
| CN | 102822350 A | 12/2012 |
| DE | 288618 A5 | 4/1991 |
| DE | 10000600 A1 | 7/2001 |
| DE | 10116399 A1 | 10/2002 |
| DE | 10256353 A1 | 6/2003 |
| DE | 10256354 A1 | 6/2003 |
| DE | 10256367 A1 | 6/2003 |
| DE | 10204951 A1 | 8/2003 |
| DE | 10234875 A1 | 2/2004 |
| DE | 10234876 A1 | 2/2004 |
| DE | 102004054666 A1 | 5/2006 |
| DE | 102005014638 A1 | 10/2006 |
| DE | 102005014906 A1 | 10/2006 |
| DE | 102007012168 A1 | 9/2008 |
| DE | 102010042866 A1 | 5/2011 |
| EP | 0 375 408 A1 | 6/1990 |
| EP | 0 804 600 A1 | 11/1997 |
| EP | 1 157 991 A2 | 11/2001 |
| EP | 1 238 586 A1 | 9/2002 |
| EP | 1 416 049 A1 | 5/2004 |
| EP | 2 147 919 A1 | 1/2010 |
| EP | 2 160 098 B1 | 11/2010 |
| EP | 2 530 159 A1 | 3/2011 |
| EP | 2 305 813 A2 | 4/2011 |
| EP | 2 545 182 A1 | 1/2013 |
| EP | 2 703 489 A1 | 3/2014 |
| EP | 2 703 490 A1 | 3/2014 |
| EP | 2 706 114 A1 | 3/2014 |
| JP | 2001253874 A | 9/2001 |
| JP | 2002080454 A | 3/2002 |
| JP | 2002138075 A | 5/2002 |
| JP | 2002145707 A | 5/2002 |
| JP | 2002220389 A | 8/2002 |
| JP | 2003064059 A | 3/2003 |
| JP | 2003096059 A | 4/2003 |
| JP | 2004051628 A | 2/2004 |
| JP | 2004107228 A | 4/2004 |
| JP | 2005008583 A | 1/2005 |
| JP | 2005239675 A | 9/2005 |
| JP | 2005314407 A | 11/2005 |
| JP | 2006232824 A | 9/2006 |
| JP | 2006282552 A | 10/2006 |
| JP | 2007153847 A | 6/2007 |
| JP | 2007161701 A | 6/2007 |
| JP | 2007182404 A | 7/2007 |
| JP | 2008074840 A | 4/2008 |
| JP | 2008074841 A | 4/2008 |
| JP | 2008133207 A | 6/2008 |
| JP | 2008133218 A | 6/2008 |
| JP | 2008169121 A | 7/2008 |
| JP | 2009-508481 A | 3/2009 |
| JP | 2009067739 A | 4/2009 |
| JP | 2009114128 A | 5/2009 |
| JP | 2009126792 A | 6/2009 |
| JP | 2009137851 A | 6/2009 |
| WO | WO 89/11789 A1 | 12/1989 |
| WO | WO 95/34659 A1 | 12/1995 |
| WO | WO 95/34668 A2 | 12/1995 |
| WO | WO 96/005721 A1 | 2/1996 |
| WO | WO 96/033270 A1 | 10/1996 |
| WO | WO 96/038567 A2 | 12/1996 |
| WO | WO 96/040964 A2 | 12/1996 |
| WO | WO 97/47193 | 12/1997 |
| WO | WO 97/49816 A1 | 12/1997 |
| WO | WO 99/024585 A1 | 5/1999 |
| WO | WO 99/26467 A1 | 6/1999 |
| WO | WO 99/27116 A2 | 6/1999 |
| WO | WO 99/32619 A1 | 7/1999 |
| WO | WO 99/61631 A1 | 12/1999 |
| WO | WO 99/67367 A1 | 12/1999 |
| WO | WO 00/04176 A1 | 1/2000 |
| WO | WO 00/32757 A2 | 6/2000 |
| WO | WO 00/044914 A1 | 8/2000 |
| WO | WO 01/07601 A2 | 2/2001 |
| WO | WO 01/34815 A1 | 5/2001 |
| WO | WO 2001/085970 A2 | 11/2001 |
| WO | WO 02/14472 A2 | 2/2002 |

(56) References Cited

FOREIGN PATENT DOCUMENTS

| | | |
|---|---|---|
| WO | WO 02/066660 A2 | 8/2002 |
| WO | WO 03/000679 A2 | 1/2003 |
| WO | WO 03/004649 | 1/2003 |
| WO | WO 03/006422 A1 | 1/2003 |
| WO | WO 03/012052 A2 | 2/2003 |
| WO | WO 03/013247 A1 | 2/2003 |
| WO | WO 03/016308 A1 | 2/2003 |
| WO | WO 2003/014357 A1 | 2/2003 |
| WO | WO 03/020704 A1 | 3/2003 |
| WO | WO 03/022051 A1 | 3/2003 |
| WO | WO 03/022831 A1 | 3/2003 |
| WO | WO 03/022843 A1 | 3/2003 |
| WO | WO 03/029243 A2 | 4/2003 |
| WO | WO 03/037085 A1 | 5/2003 |
| WO | WO 03/037878 A1 | 5/2003 |
| WO | WO 03/045878 A2 | 6/2003 |
| WO | WO 03/050087 A2 | 6/2003 |
| WO | WO 03/051823 A1 | 6/2003 |
| WO | WO 03/051824 A1 | 6/2003 |
| WO | WO 03/051846 A2 | 6/2003 |
| WO | WO 03/064625 A2 | 8/2003 |
| WO | WO 03/076409 A1 | 9/2003 |
| WO | WO 03/077648 A2 | 9/2003 |
| WO | WO 03/087067 A1 | 10/2003 |
| WO | WO 03/090539 A1 | 11/2003 |
| WO | WO 03/091217 A1 | 11/2003 |
| WO | WO 03/093269 A2 | 11/2003 |
| WO | WO 03/104206 A2 | 12/2003 |
| WO | WO 2004/002947 A1 | 1/2004 |
| WO | WO 2004/002981 A2 | 1/2004 |
| WO | WO 2004/005485 A2 | 1/2004 |
| WO | WO 2004/009761 A2 | 1/2004 |
| WO | WO 2004/011429 A1 | 2/2004 |
| WO | WO 2004/022771 A2 | 3/2004 |
| WO | WO 2004/029060 A1 | 4/2004 |
| WO | WO 2004/035545 A2 | 4/2004 |
| WO | WO 2004/035563 A1 | 4/2004 |
| WO | WO 2004/035564 A1 | 4/2004 |
| WO | WO 2004/037787 A1 | 5/2004 |
| WO | WO 2004/049806 A1 | 6/2004 |
| WO | WO 2004/062351 A2 | 7/2004 |
| WO | WO 2004/067518 A1 | 8/2004 |
| WO | WO 2004/067527 A1 | 8/2004 |
| WO | WO 2004/074443 A2 | 9/2004 |
| WO | WO 2004/077950 A1 | 9/2004 |
| WO | WO 2005/000824 A1 | 1/2005 |
| WO | WO 2005/003362 A2 | 1/2005 |
| WO | WO 2005/007627 A1 | 1/2005 |
| WO | WO 2005/007860 A1 | 1/2005 |
| WO | WO 2005/040152 A1 | 5/2005 |
| WO | WO 2005/047233 A1 | 5/2005 |
| WO | WO 2005/047281 A1 | 5/2005 |
| WO | WO 2005/061443 A2 | 7/2005 |
| WO | WO 2005/061464 A1 | 7/2005 |
| WO | WO 2005/068434 A1 | 7/2005 |
| WO | WO 2005/070889 A1 | 8/2005 |
| WO | WO 2005/089551 A1 | 9/2005 |
| WO | WO 2005/095335 A1 | 10/2005 |
| WO | WO 2005/107437 A2 | 11/2005 |
| WO | WO 2005/110068 A2 | 11/2005 |
| WO | WO 2006/006569 A1 | 1/2006 |
| WO | WO 2006/024820 A1 | 3/2006 |
| WO | WO 2006/029828 A1 | 3/2006 |
| WO | WO 2006/029829 A1 | 3/2006 |
| WO | WO 2006/037945 A1 | 4/2006 |
| WO | WO 2006/050803 A1 | 5/2006 |
| WO | WO 2006/074400 A2 | 7/2006 |
| WO | WO 2006/090792 A1 | 8/2006 |
| WO | WO 2006/123088 A2 | 11/2006 |
| WO | WO 2006/125687 A1 | 11/2006 |
| WO | WO 2006/125688 A1 | 11/2006 |
| WO | WO 2006/138638 A1 | 12/2006 |
| WO | WO 2007/003294 A1 | 1/2007 |
| WO | WO 2007/007316 A1 | 1/2007 |
| WO | WO 2007/024783 | 3/2007 |
| WO | WO 2007/026834 A1 | 3/2007 |
| WO | WO 2007/035650 A2 | 3/2007 |
| WO | WO 2007/038788 A2 | 4/2007 |
| WO | WO 2007/039454 A1 | 4/2007 |
| WO | WO 2007/050715 A2 | 5/2007 |
| WO | WO 2007/051462 A2 | 5/2007 |
| WO | WO 2007/070389 A2 | 6/2007 |
| WO | WO 2007/071900 A1 | 6/2007 |
| WO | WO 2007/074405 A2 | 7/2007 |
| WO | WO 2007/074976 A1 | 7/2007 |
| WO | WO 2007/077201 A1 | 7/2007 |
| WO | WO 2007/077247 A1 | 7/2007 |
| WO | WO 2007/080126 A2 | 7/2007 |
| WO | WO 2007/080127 A2 | 7/2007 |
| WO | WO 2007/083193 A2 | 7/2007 |
| WO | WO 2007/096576 A1 | 8/2007 |
| WO | WO 2007/051462 A3 | 10/2007 |
| WO | WO 2007/119434 A1 | 10/2007 |
| WO | WO 2007/134984 A1 | 11/2007 |
| WO | WO 2008/007100 A2 | 1/2008 |
| WO | WO 2008/009908 A1 | 1/2008 |
| WO | WO 2008/029084 A1 | 3/2008 |
| WO | WO 2008/042231 A2 | 4/2008 |
| WO | WO 2008/059948 A1 | 5/2008 |
| WO | WO 2008/063203 A2 | 5/2008 |
| WO | WO 2008/071918 A1 | 6/2008 |
| WO | WO 2008/074991 A1 | 6/2008 |
| WO | WO 2008/084073 A1 | 7/2008 |
| WO | WO 2008/100426 A2 | 8/2008 |
| WO | WO 2008/102908 A1 | 8/2008 |
| WO | WO 2008/148223 A1 | 12/2008 |
| WO | WO 2008/152072 A2 | 12/2008 |
| WO | WO 2008/152073 A2 | 12/2008 |
| WO | WO 2009/000757 A1 | 12/2008 |
| WO | WO 2009/005297 A2 | 1/2009 |
| WO | WO 2009/029690 A1 | 3/2009 |
| WO | WO 2009/035150 A2 | 3/2009 |
| WO | WO 2009/037329 A2 | 3/2009 |
| WO | WO 2009/046384 A1 | 4/2009 |
| WO | WO 2009/060429 A2 | 5/2009 |
| WO | WO 2009/063180 A1 | 5/2009 |
| WO | WO 2009/068170 A2 | 6/2009 |
| WO | WO 2009/068171 A2 | 6/2009 |
| WO | WO 2009/086041 A1 | 7/2009 |
| WO | WO 2009/090402 A2 | 7/2009 |
| WO | WO 2009/091862 A2 | 7/2009 |
| WO | WO 2009/091863 A1 | 7/2009 |
| WO | WO 2009/115788 A1 | 9/2009 |
| WO | WO 2009/116558 A1 | 9/2009 |
| WO | WO 2009/125401 A2 | 10/2009 |
| WO | WO 2009/152995 A1 | 12/2009 |
| WO | WO 2009/158258 A1 | 12/2009 |
| WO | WO 2010/012649 A1 | 2/2010 |
| WO | WO 2010/026989 A1 | 3/2010 |
| WO | WO 2010/034153 A1 | 4/2010 |
| WO | WO 2010/049270 A1 | 5/2010 |
| WO | WO 2010/049369 A1 | 5/2010 |
| WO | WO 2010/049405 A1 | 5/2010 |
| WO | WO 2010/049414 A1 | 5/2010 |
| WO | WO 2010/056519 A1 | 5/2010 |
| WO | WO 2010/063422 A1 | 6/2010 |
| WO | WO 2010/069802 A1 | 6/2010 |
| WO | WO 2010/078906 A2 | 7/2010 |
| WO | WO 2010/078912 A1 | 7/2010 |
| WO | WO 2010/093788 A2 | 8/2010 |
| WO | WO 2010/104217 A1 | 9/2010 |
| WO | WO 2010/108611 A1 | 9/2010 |
| WO | WO 2010/112826 A2 | 10/2010 |
| WO | WO 2010/116122 A2 | 10/2010 |
| WO | WO 2010/119906 A1 | 10/2010 |
| WO | WO 2010/128465 A1 | 11/2010 |
| WO | WO 2010/130970 A1 | 11/2010 |
| WO | WO 2011/001434 A1 | 1/2011 |
| WO | WO 2011/003776 A2 | 1/2011 |
| WO | WO 2011/021171 A1 | 2/2011 |
| WO | WO 2011/035874 A1 | 3/2011 |
| WO | WO 2011/045796 A1 | 4/2011 |
| WO | WO 2011/065451 A1 | 6/2011 |
| WO | WO 2011/067745 A2 | 6/2011 |

(56) References Cited

FOREIGN PATENT DOCUMENTS

| | | |
|---|---|---|
| WO | WO 2011/075188 A1 | 6/2011 |
| WO | WO 2011/080674 A2 | 7/2011 |
| WO | WO 2011/112570 A1 | 9/2011 |
| WO | WO 2011/132127 A1 | 10/2011 |
| WO | WO 2012/001626 A1 | 1/2012 |
| WO | WO 2012/056401 A1 | 5/2012 |
| WO | WO 2012/092580 A2 | 7/2012 |
| WO | WO 2012/164100 A2 | 12/2012 |
| WO | WO 2013/010691 A1 | 1/2013 |
| WO | WO 2013/025670 A1 | 2/2013 |
| WO | WO 2013/039990 A1 | 3/2013 |
| WO | WO 2013/040005 A1 | 3/2013 |
| WO | WO 2013/040021 A1 | 3/2013 |
| WO | WO 2013/040033 A1 | 3/2013 |
| WO | WO 2013/040049 A1 | 3/2013 |
| WO | WO 2013/040057 A1 | 3/2013 |
| WO | WO 2013/040116 A9 | 3/2013 |
| WO | WO 2013/040117 A9 | 3/2013 |
| WO | WO 2013/153553 A2 | 10/2013 |
| WO | WO 2013/175480 A1 | 11/2013 |
| WO | WO 2014/022739 A2 | 2/2014 |
| WO | WO 2014/106837 A2 | 7/2014 |
| WO | WO 2014/106838 A2 | 7/2014 |
| WO | WO 2014/151255 A1 | 9/2014 |
| WO | WO 2014/164761 A1 | 10/2014 |
| WO | WO 2014/164797 A2 | 10/2014 |
| WO | WO 2015/010026 A2 | 1/2015 |
| WO | WO 2016/018887 A1 | 2/2016 |

OTHER PUBLICATIONS

Yibrah et al. 1993, Hereditas 118:273-2890.*
Bachman et al., "Characterization of the spectrum of insecticidal activity of a double-stranded RNA with targeted activity against Western Corn Rootworm (*Diabrotica virgifera virgifera* LeConte)," Transgenic Res., 22(6):1207-22 (2013).
Chu et al., "Potent RNAi by short RNA triggers," RNA, 14:1714-1719 (2008).
Advisory Action dated Feb. 22, 2013, in U.S. Appl. No. 13/332,430.
Agricultural Chemical Usage 2006 Vegetables Summary, Agricultural Statistics Board, NASS, USDA, pp. 1-372 (2007).
Agrios, Plant Pathology (Second Edition), 2:466-470 (1978).
Amarzguioui et al., "An algorithm for selection of functional siRNA sequences," Biochemical and Biophysical Research Communications, 316:1050-1058 (2004).
Amdam et al., Disruption of vitellogenin gene function in adult honeybees by intra-abdominal injection of double-stranded RNA, BMC Biotechnology, 3(1):1-8 (2003).
An et al., "Transient RNAi Induction against Endogenous Genes in *Arabidopsis* Protoplasts Using in Vitro-Prepared Double-Stranded RNA," Biosci Biotechnol Biochem, 69(2):415-418 (2005).
Andersen et al., "Delivery of siRNA from lyophilized polymeric surfaces," Biomaterials, 29:506-512 (2008).
Anonymous, "Agronomy Facts 37: Adjuvants for enhancing herbicide performance," n.p., 1-8, (Jan. 26, 2000), Web, (Jan. 21, 2014).
Aoki et al., "In Vivo Transfer Efficiency of Antisense Oligonucleotides into the Myocardium Using HVJ—Liposome Method," Biochem Biophys Res Commun, 231:540-545 (1997).
Arpaia et al., "Production of transgenic eggplant (*Solanum melongena* L.) resistant to Colorado Potato Beetle (*Leptinotarsa decemlineata* Say)," (1997) Theor. Appl. Genet., 95:329-334 (1997).
Artymovich, "Using RNA interference to increase crop yield and decrease pest damage," MMG 445 Basic Biotech., 5(1):7-12 (2009).
Ascencio-Ibanez et al., "DNA abrasion onto plants is an effective method for geminivirus infection and virus-induced gene silencing," Journal of Virological Methods, 142:198-203 (2007).
Axtell et al., "A Two-Hit Trigger for siRNA Biogenesis in Plants," Cell, 127:565-577 (2006).

Bachman et al., "Characterization of the spectrum of insecticidal activity of a double-stranded RNA with targeted activity against Western Corn Rootworm (*Diabrotica virgifera virgifera* LeConte)," Transgenic Res., pp. 1-16 (2013).
Bart et al., "A novel system for gene silencing using siRNAs in rice leaf and stem-derived protoplasts," Plant Methods, 2(13):1-9 (2006).
Baulcombe, "RNA silencing and heritable epigenetic effects in tomato and *Arabidopsis*," Abstract 13th Annual Fall Symposium, Plant Genomes to Phenomes, Donald Danforth Plant Science Center, 28-30 (2011).
Baum et al., "Control of coleopteran insect pests through RNA interference," Nature Biotechnology, 25(11):1322-1326 (2007).
Baum et al., "Progress Towards RNAi-Mediated Insect Pest Management" Advances in Insect Physiology, 47:249-295 (2014).
Bayer et al., "Programmable ligand-controlled riboregulators of eukaryotic gene expression," Nature Biotechnol., 23(3):337-343 (2005).
Beal, et al., "Second Structural Motif for Recognition of DNA by Oligonucleotide-Directed Triple-Helix Formation," Science, 251:1360-1363 (1992).
Becker et al., "Fertile transgenic wheat from microprojectile bombardment of scutellar tissue," The Plant Journal, 5(2):299-307 (1994).
Bhargava et al., "Long double-stranded RNA-mediated RNA interference as a tool to achieve site-specific silencing of hypothalamic neuropeptides," Brain Research Protocols, 13:115-125 (2004).
Bhatia et al., "Aphid resistance in *Brassica* crops: Challenges, biotechnological progress and emerging possibilities," Biotechnology Advances 29:879-955 (2011).
Boletta et al., "High Efficient Non-Viral Gene Delivery to the Rat Kidney by Novel Polycationic Vectors," J. Am Soc. Nephrol., 7:1728 (1996).
Bolognesi et al., "Characterizing the Mechanism of Action of Double-Stranded RNA Activity against Western Corn Rootworm(*Diabrotica virgifera virgifera* LeConte)," PLoS One 7(10):e47534 (2012).
Breaker et al., "A DNA enzyme with Mg2+-dependent RNA phosphoesterase activity," Chemistry and Biology, 2:655-660 (1995).
Brodersen et al., "The diversity of RNA silencing pathways in plants," Trends in Genetics, 22(5):268-280 (2006).
Busch et al., "RNAi for discovery of novel crop protection products," Pflanzenschutz-Nachrichten Bayer, 58(1):34-50 (2005).
Campbell et al., "Gene-knockdown in the honey bee mite Varroa destructor by a non-invasive approach: studies on a glutathione S-transferase," Parasites & Vectors, 3(1):73, pp. 1-10 (2010).
Carthew, "Gene silencing by double-stranded RNA," Curr Opin Cell Biol., 13(2):244-248 (2001).
Chabannes et al., "In situ analysis of lignins in transgenic tobacco reveals a differential impact of individual transformations on the spatial patterns of lignin deposition at the cellular and subcellular levels," The Plant Journal, 28(3):271-282 (2001).
Chabbouh et al., "Cucumber mosaic virus in artichoke," FAO Plant Protection Bulletin, 38:52-53 (1990).
Chang et al., "Dual-target gene silencing by using long, sythetic siRNA duplexes without triggering antiviral responses," Molecules and Cells, 27(6) 689-695 (2009).
Chang et al., "Cellular Internalization of Fluorescent Proteins via Arginine-rich Intracellular Delivery Peptide in Plant Cells," Plant Cell Physiol., 46(3):482-488 (2005).
Chen et al., "Exploring MicroRNA-Like Small RNAs in the Filamentous Fungus *Fusarium oxysporum*," PLOS One, 9(8):e104956:1-10 (2014).
Christiaens et al., "The challenge of RNAi-mediated control of hemipterans," Current Opinion in Insect Science, 6:15-21 (2014).
CN101914540 Patent Diclosure, "Introduction of RNA into plant by interference," (2010).
Colorado Potato Beetle, *Leptinotarsa decemlineata*,Transcriptome, PLoS One, 9(1):e86012 (2014).
Communication pursuant to Article 94(3) EPC dated Jan. 14, 2016, in European Patent Application No. 12 832 415.9.
Communication pursuant to Article 94(3) EPC dated Jun. 26, 2015, in European Patent Application No. 11 753 916.3.

(56) References Cited

OTHER PUBLICATIONS

Communication pursuant to Article 94(3) EPC dated Mar. 18, 2016, in European Patent Application No. 12 832 160.1.
Communication pursuant to Article 94(3) EPC dated Mar. 24, 2016, in European Patent Application No. 12 831 684.1.
Communication pursuant to Article 94(3) EPC dated Mar. 4, 2016, in European Patent Application No. 12 830 932.5.
Communication pursuant to Article 94(3) EPC dated Mar. 9, 2016, in European Patent Application No. 12 831 166.9.
Communication pursuant to Article 94(3) EPC dated Oct. 23, 2015, in European Patent Application No. 12 831 945.6.
Concise Descriptions of Relevance filed by a third party on Nov. 29, 2012, in U.S. Appl. No. 13/042,856.
Constan et al., "An outer envelope membrane component of the plastid protein import apparatus plays an essential role in *Arabidopsis*," The Plant Journal, 38:93-106 (2004).
Cooney et al., "Site-Specific Oligonucleotide Binding Represses Transcription of the Human c-myc Gene in Vitro," Science,241:456-459 (1988).
Cost Action FA0806 progress report "Plant virus control employing RNA-based vaccines: A novel non-transgenic strategy" (2010).
Cox-Foster et al., "A Metagenomic Survey of Microbes in Honey Bee Colony Collapse Disorder," *Science*, 318(5848):283-287 (2007).
Dalakouras et al., "Induction of Silencing in Plants by High-Pressure Spraying of In vitro-Synthesized Small RNAs," Frontiers in Plant Science, 7(1327):1-5 (2016).
Dalmay et al., "An RNA-Depenedent RNA Polymerase Gene in *Arabidopsis* Is Required for Posttranscriptional Gene Silencing Mediated by a Transgene but Not by a Virus," Cell, 101:543-553 (2000).
Davidson et al., "Engineering regulatory RNAs," Trends in Biotechnology, 23(3):109-112 (2005).
Dawson et al., "cDNA cloning of the complete genome of tobacco mosaic virus and production of infectious transcripts," Proc. Natl. Acad. Sci. USA, 83:1832-1836 (1986).
De Framond, "MINI-Ti: A New Vector Strategy for Plant Genetic Engineering," Nature Biotechnology, 1:262-269 (1983).
Desai et al., "Reduction in deformed wing virus infection in larval and adult honey bees (*Apis mellifera* L.) by double-stranded RNA ingestion," Insect Molecular Biology, 21(4):446-455 (2012).
Di Prisco et al. "Varroa Destructor Is an Effective Vector of Israeli Acute Paralysis Virus in the Honeybee, *Apis mellifera*", Journal of General Virology, 92: 151-155, 2011.
Di Stilio et al., "Virus-Induced Gene Silencing as a Tool for Comparative Functional Studies in Thalictrum," PLoS One, 5(8):e12064 (2010).
Diallo et al., "Long Endogenous dsRNAs Can Induce Complete Gene Silencing in Mammalian Cells and Primary Cultures," Oligonucleotides, 13:381-392 (2003).
Dietemann et al, "Varroa destructor: research avenues towards sustainable control," Journal of Apicultural Research, 51(1):125-132 (2012).
Dietzl et al., "A genome-wide transgenic RNAi library for conditional gene inactivation in *Drosophila*," *Nature*, 448:151-157 (2007).
Du et al., "A systematic analysis of the silencing effects of an active siRNA at all single-nucleotide mismatched target sites," Nucleic Acids Research, 33(5):1671-1677 (2005).
Dunoyer et al., "Small RNA Duplexes Function as Mobile Silencing Signals Between Plant Cells," Science, 328:912-916 (2010).
Eamens et al., "RNA Silencing in Plants: Yesterday, Today, and Tomorrow," Plant Physiology, 147(2):456-468 (2008).
Ellington et al., "In vitro selection of RNA molecules that bind specific ligands," Nature, 346:818-822 (1990).
Eudes et al., "Cell-penetrating peptides," Plant Signaling & Behavior, 3(8):549-5550 (2008).
European Cooperation in the field of Scientific and Technical Research—Memorandum of Understanding for COST Action FA0806 (2008).
European Search Report and the European Search Opinion dated Feb. 3, 2014, in European Patent Application No. 13156180.4.
European Search Report and the European Search Opinion dated Feb. 3, 2014, in European Patent Application No. 13156180.5.
European Search Report dated Feb. 3, 2014, in European Patent Application No. 13156180.4.
European Search Report dated Feb. 3, 2014, in European Patent Application No. 13156180.5.
European Search Report dated Feb. 6, 2014, in European Patent Application No. 13156183.9.
European Search Report dated Jun. 29, 2018, in European Patent Application No. 18157745.3.
European Search Report dated Sep. 7, 2017, in European Patent Application No. 17152830.0.
Examination Report dated Mar. 1, 2018, in Australian Patent Application No. 2013264742.
Extended European Search Report dated Feb. 2, 2015, in European Patent Application No. 12 830 932.5.
Extended European Search Report dated Feb. 27, 2015, in European Patent Application No. 12 832 160.1.
Extended European Search Report dated Feb. 3, 2015, in European Patent Application No. 12 831 945.6.
Extended European Search Report dated Feb. 6, 2014, in European Patent Application No. 13156183.9.
Extended European Search Report dated Jan. 20, 2016, in European Patent Application No. 13 794 339.5.
Extended European Search Report dated Jan. 21, 2015, in European Patent Application No. 12 832 415.9.
Extended European Search Report dated Jan. 29, 2015, in European Patent Application No. 12 831 567.8.
Extended European Search Report dated Jun. 29, 2015, in European Patent Application No. 12 831 494.5.
Extended European Search Report dated Mar. 17, 2015, in European Patent Application No. 12 831 684.1.
Extended European Search Report dated Mar. 3, 2015, in European Patent Application No. 12 831 166.9.
Extended European Search Report dated May 23, 2018, in European Patent Application No. 15826865.6.
Extended European Search Report dated Nov. 7, 2017, in European Patent Application No. 15811092.4.
Extended European Search Report dated Nov. 8, 2017, in European Patent Application No. 15737282.2.
Extended European Search Report dated Oct. 8, 2013, in European Patent Application No. 11753916.3.
Extended European Search Report dated Sep. 29, 2016, in European Patent Application No. 14778840.0.
Extended European Search Report dated Apr. 13, 2018, in European Patent Application No. 15812530.0.
Extended European Search Report dated Mar. 15, 2018, in European Patent Application No. 17181861.0.
Fairbairn et al. "Host-Delivered RNAi: An Effective Strategy to Silence Genes in Plant Parasitic Nematodes", Planta, 226(6):1525-1533 (2007) Abstract.
Fernandez et al., "Uptake of Hydrophilic Solutes Through Plant Leaves: Current State of Knowledge and Perspectives of Foliar Fertilization," Critical Reviews in Plant Sciences, 28:36-38 (2009).
Fiala et al., "Reversible Downregulation of Protein Kinase a during Olfactory Learning Using Antisense Technique Impairs Long-Term Memory Formation in the Honeybee, *Apis mellifera*," J. Neuroscience, 19:10125-10134 (1999).
Final Office Action dated Apr. 7, 2016, in U.S. Appl. No. 13/619,980.
Final Office Action dated Aug. 1, 2013, in U.S. Appl. No. 13/318,636.
Final Office Action dated Dec. 17, 2015, in U.S. Appl. No. 14/335,135.
Final Office Action dated Feb. 17, 2016, in U.S. Appl. No. 13/612,929.
Final Office Action dated Feb. 4, 2016, in U.S. Appl. No. 13/612,936.
Final Office Action dated Jun. 30, 2016, in U.S. Appl. No. 13/901,326.
Final Office Action dated Mar. 18, 2011, in U.S. Appl. No. 12/222,949.
Final Office Action dated Mar. 2, 2016, in U.S. Appl. No. 13/612,995.
Final Office Action dated Mar. 21, 2016, in U.S. Appl. No. 13/612,925.
Final Office Action dated May 26, 2016, in U.S. Appl. No. 14/532,596.
Final Office Action dated Nov. 10, 2015, in U.S. Appl. No. 13/612,985.
Final Office Action dated Nov. 10, 2016, in U.S. Appl. No. 13/583,302.
Final Office Action dated Nov. 19, 2015, in U.S. Appl. No. 13/612,941.
Final Office Action dated Nov. 30, 2015, in U.S. Appl. No. 13/612,948.
Final Office Action dated Nov. 7, 2013, in U.S. Appl. No. 13/042,856.

(56) References Cited

OTHER PUBLICATIONS

Final Office Action dated Oct. 15, 2012, in U.S. Appl. No. 13/332,430.
Final Office Action dated Oct. 20, 2016, in U.S. Appl. No. 14/480,199.
Final Office Action dated Oct. 22, 2015, in U.S. Appl. No. 14/608,951.
Final Office Action dated Sep. 9, 2016, in U.S. Appl. No. 13/612,954.
Final Office Action dated Sep. 9, 2016, in U.S. Appl. No. 14/603,347.
Final Office Action dated Sep. 9, 2016, in U.S. Appl. No. 14/608,951.
Fire et al., "Potent and specific genetic interference by double-stranded RNA in Caenorhabditis elegans," Nature, 391:806-811 (1998).
First Examination Report dated Apr. 23, 2013, in New Zealand Patent Application No. 601784.
First Examination Report dated Jul. 28, 2014, in New Zealand Patent Application No. 627060.
First Office Action dated Aug. 31, 2015, in Chinese Patent Application No. 201280053985.3.
First Office Action dated Feb. 2, 2016, in Chinese Patent Application No. 201380039346.6.
First Office Action dated Jul. 7, 2015, in Chinese Patent Application No. 201280054820.8.
First Office Action dated Mar. 12, 2015, in Chinese Patent Application No. 201280053984.9.
First Office Action dated Mar. 2, 2015, in Chinese Patent Application No. 201280054819.5.
First Office Action dated May 27, 2015, in Chinese Patent Application No. 201280054179.8.
First Office Action dated Sep. 9, 2015, in Chinese Patent Application No. 201280055409.2.
Foley et al., "The distribution of *Aspergillus* spp. Opportunistic parasites in hives and their pathogenicity to honey bees," *Veterinary Microbiology*, 169:203-210 (2014).
Fraley et al., "Liposome-mediated delivery of tobacco mosaic virus RNA into tobacco protoplasts: A sensitive assay for monitoring liposome-protoplast interactions," Proc Natl Acad Sci U S A., 79(6):1859-1863 (1982).
Friedberg, "Automated protein function prediction—the genomic challenge," Briefings in Bioinformatics, 7(3):225-242 (2006).
Fukuhara et al., "Enigmatic Double-Stranded RNA in Japonica Rice," Plant Molecular Biology, 21:1121-1130 (1993).
Fukuhara et al., "The Unusual Structure of a Novel RNA Replicon in Rice," The Journal of Biological Chemistry, 270(30):18147-18149 (1995).
Fukuhara et al., "The wide distribution of endornaviruses, large double-stranded RNA replicons with plasmid-like properties," Archives of Virology, 151:995-1002 (2006).
Fukunaga et al., "dsRNA with 5' overhangs v contributes to endogenous and antiviral RNA silencing pathways in plants," The EMBO Journal, 28(5):545-555 (2009).
Further Examination Report dated May 16, 2014, in New Zealand Patent Application No. 601784.
Gallie et al., "Identification of the motifs within the tobacco mosaic virus 5'-leader responsible for enhancing translation," Nucleic Acids Res., 20(17):4631-4638 (1992).
Gan et al., "Bacterially expressed dsRNA protects maize against SCMV infection," Plant Cell Rep, 29(11):1261-1268 (2010).
Gao et al., "Down-regulation of acetolactate synthase compromises O1-1-mediated resistance to powdery mildew in tomato," BMC Plant Biology, 14 (2014).
Gao et al., "Nonviral Methods for siRNA Delivery," Molecular Pharmaceutics, 6(3):651-658 (2008).
Garbian et al., "Bidirectional Transfer of RNAi between Honey Bee and Varroa destructor: Varroa Gene Silencing Reduces Varroa Population," 8(12):1-9:e1003035 (2012).
Gaskin et al., "Novel organosillicone adjuvants to reduce agrochemical spray volumes on row crops," New Zealand Plant Protection, 53:350-354 (2000).
Gill et al. "Stripped-Down DNA Repair in a High Reduced Parasite", BMC Molecular Biology, 8(24): 1-14, Mar. 20, 2007.

Gomez-Zurita et al., "Recalibrated Tree of Leaf Beetles (*Chrysomelidae*) Indicates Independent Diversification of Angiosperms and Their Insect Herbivores," PLoS One, 4(e360):1-8 (2007).
Gong et al., "Silencing of Rieske iron—sulfur protein using chemically synthesised siRNA as a potential biopesticide against Plutella xylostella," Pest Manag Sci, 67:514-520 (2011).
Gossamer Threads, Compendium of Herbicide Adjuvants: Organo-Silicone Surfactant, p. 1-4 (1998).
Hagio, "Chapter 25: Direct Gene Transfer into Plant Mature Seeds via Electroporation After Vacuum Treatment," Electroporation and Sonoporation in Developmental Biology, p. 285-293 (2009).
Hamilton et al., "Two classes of short interfering RNA in RNA silencing," EMBO J., 21(17):4671-4679 (2002).
Han et al., "Molecular Basis for the Recognition of Primary microRNAs by the Drosha-DGCR8 Complex," Cell, 125(5):887-901 (2006).
Hannon, "RNA interference," Nature,481:244-251 (2002).
Henderson et al., "U.S. National Bee Colony Loss Survey, www.beesurvey.com, Preliminary Findings With Respect to Colony Collapse Disorder (CCD)," Bee Alert Technology, Inc. (2007).
Heneberg et al., "Assemblage of filamentous fungi associated with aculeate hymenopteran brood in reed galls," *Journal of Invertebrate Pathology*, 133:95-106 (2016).
Herman et al., "A three-component dicamba O-demethylase from Pseudomonas maltophilia, strain DI-6: gene isolation, characterization, and heterologous expression," J. Biol. Chem., 280: 24759-24767 (2005).
Hess, "Surfactants and Additives," 1999 Proceedings of the California Weed Science Society, 51:156-172 (1999).
Hewezi et al., "Local infiltration of high- and low-molecular-weight RNA from silenced sunflower (*Helianthus annuus* L.) plants triggers post-transcriptional gene silencing in non-silenced plants," Plant Biotechnology Journal, 3:81-89 (2005).
Himber et al., "Transitivity-dependant and -independent cell-to-cell movement of RNA silencing," The EMBO Journal, 22(17):4523-4533 (2003).
Hsieh et al., "A library of siRNA duplexes targeting the phosphoinositide 3-kinase pathway: determinants of gene silencing for use in cell-based screens," Nucleic Acids Res., 32(3):893-901.
Hu et al., "High efficiency transport of quantum dots into plant roots with the aid of silwet L-77," Plant Physiology and Biochemistry, 48:703-709 (2010).
Huang et al., "Engineering broad root-know resistance in transgenic plants by RNAi silencing of a conserved and essential root-knot nematode parasitism gene," *Proc. Natl. Acad. Sci. USA*, 103(39):14302-14306 (2006).
Huesken et al., "Design of a genome-wide siRNA library using an artificial neural network," Nature Biotechnology, 23(8): 995-1001 (2005).
Hunter et al., "Large-Scale Field Application of RNAi Technology Reducing Israeli Acute Paralysis Virus Disease in Honey Bees (*Apis mellifera*, Hymenoptera: Apidae)," PLoS Pathogens, 6(12):e1001160-1-e1 001160-10 (2010).
Hunter et al., "RNA Interference Strategy to suppress Psyllids & Leafhoppers," International Plant and Animal Genome XIX, 15-19 (2011).
Huvenne et al., "Mechanisms of dsRNA uptake in insects and potential of RNAi for pest control: A review," *Journal of Insect Physiology*, 56:227-235 (2010).
Ichihara et al., "Thermodynamic instability of siRNA duplex is a prerequisite for dependable prediction of siRNA activities," Nucleic Acids Res., 35(18):e123 (2007).
International Preliminary Report on Patentability (Chapter II) dated Jul. 24, 2015, in International Application No. PCT/US2014/047204.
International Preliminary Report on Patentability dated Apr. 26, 2012, in International Application No. PCT/IL2010/000844.
International Preliminary Report on Patentability dated Feb. 1, 2010, in International Application No. PCT/IL2008/001440.
International Preliminary Report on Patentability dated Feb. 21, 2012, in International Application No. PCT/IB2010/053776.
International Preliminary Report on Patentability dated Mar. 1, 2010, in International Application No. PCT/IB2010/053776.

(56) References Cited

OTHER PUBLICATIONS

International Preliminary Report on Patentability dated Nov. 17, 2011, in International Application No. PCT/IB2010/051980.
International Preliminary Report on Patentability dated Oct. 23, 2014, in International Application No. PCT/IL2013/050321.
International Preliminary Report on Patentability dated Sep. 11, 2012, in International Application No. PCT/US2011/027528.
International Preliminary Report on Patentability dated Sep. 11, 2014, in International Application No. PCT/IL2013/050447.
International Rice Genome Sequencing Project, The map-based sequence of the rice genome, Nature, 436(11):793-800 (2005).
International Search Report and the Written Opinion dated Feb. 25, 2013, in International Application No. PCT/US2012/054883.
International Search Report and the Written Opinion dated Feb. 27, 2013, in International Application No. PCT/US2012/054814.
International Search Report and the Written Opinion dated Feb. 27, 2013, in International Application No. PCT/US2012/054842.
International Search Report and the Written Opinion dated Feb. 27, 2013, in International Application No. PCT/US2012/054862.
International Search Report and the Written Opinion dated Feb. 27, 2013, in International Application No. PCT/US2012/054894.
International Search Report and the Written Opinion dated Feb. 27, 2013, in International Application No. PCT/US2012/054974.
International Search Report and the Written Opinion dated Feb. 27, 2013, in International Application No. PCT/US2012/054980.
International Search Report and the Written Opinion dated Jul. 15, 2014, in International Application No. PCT/US2014/025305.
International Search Report and the Written Opinion dated Jul. 22, 2014, in International Application No. PCT/IL2013/051083.
International Search Report and the Written Opinion dated Jul. 22, 2014, in International Application No. PCT/IL2013/051085.
International Search Report and the Written Opinion dated Jul. 24, 2014, in International Application No. PCT/US2014/026036.
International Search Report and the Written Opinion dated May 10, 2011, in International Application No. PCT/US2011/027528.
International Search Report and the Written Opinion dated Oct. 1, 2013, in International Application No. PCT/IL2013/050447.
International Search Report and Written Opinion dated Dec. 31, 2015, in International Application No. PCT/US2015/042415.
International Search Report and Written Opinion dated Feb. 24, 2011, in International Application No. PCT/IL2010/000844.
International Search Report and Written Opinion dated Jul. 19, 2010, in International Application No. PCT/IB2010/051980.
International Search Report and Written Opinion dated Mar. 26, 2015, in International Application No. PCT/US2014/069535.
International Search Report and Written Opinion dated May 23, 2017, in International Application No. PCT/US2017/015061.
International Search Report and Written Opinion dated Nov. 30, 2010, in International Application No. PCT/IB2010/053776.
International Search Report and Written Opinion dated Oct. 17, 2016, in International Application No. PCT/US2016/030579.
International Search Report and Written Opinion dated Oct. 28, 2013, in International Application No. PCT/IL2013/050321.
International Search Report and Written Opinion dated Aug. 25, 2014, in International Application No. PCT/US2014/023503.
International Search Report and Written Opinion dated Aug. 27, 2014, in International Application No. PCT/US2014/023409.
International Search Report and Written Opinion dated Feb. 23, 2015, in International Application No. PCT/US2014/063832.
International Search Report and Written Opinion dated Jul. 8, 2015, in International Application No. PCT/US2015/011408.
International Search Report and Written Opinion dated Mar. 26, 2015, in International Application No. PCT/US2014/069353.
International Search Report and Written Opinion dated May 26, 2016, in International Application No. PCT/US2016/014344.
International Search Report and Written Opinion dated Nov. 24, 2015, in International Application No. PCT/US2015/037522.
International Search Report and Written Opinion dated Nov. 27, 2015, in International Application No. PCT/US2015/037015.

International Search Report and Written Opinion dated Oct. 1, 2015 in International Application No. PCT/US2015/022985.
International Search Report dated Aug. 13, 2009, in International Application No. PCT/IL2008/001440.
International Search Report dated Mar. 12, 2013, in International Application No. PCT/US2012/054789.
Invitation to Pay Additional Fees dated May 6, 2014, in International Application No. PCT/IL2013/051083.
Invitation to Pay Additional Fees dated May 6, 2014, in International Application No. PCT/IL2013/051085.
Invitation to Pay Additional Fees dated Nov. 25, 2014, in International Application No. PCT/US2014/047204.
Invitation to Pay Additional Fees dated Sep. 8, 2015, in International Application No. PCT/US2015/037015.
Invitation to Pay Additional Fees dated Sep. 9, 2015, in International Application No. PCT/US2015/037522.
Isaacs et al., "Engineered riboregulators enable post-transcriptional control of gene expression," Nature Biotechnology, 22(7):841-847 (2004).
Jarvis et al, "An *Arabidopsis* mutant defective in the plastid general protein import apparatus," Science, 282:100-103 (1998).
Ji et al., "Regulation of small RNA stability: methylation and beyond," Cell Research, 22:624-636 (2012).
Jin et al., "Posttranslational Elevation of Cell Wall Invertase Activity by Silencing its Inhibitor in Tomato Delays Leaf Senescence and Increases Seed Weight and Fruit Hexose Level," The Plant Cell, 21:2072-2089 (2009).
Jones-Rhoades et al., "MicroRNAs and Their Regulatory Roles in Plants," Annu. Rev. Plant Biol., 57:19-53 (2006).
Kam et al., "Nanotube Molecular Transporters: Internalization of Carbon Nanotube—Protein Conjugates into Mammalian Cells," J. Am. Chem. Soc., 126(22):6850-6851 (2004).
Katoh et al., "Specific residues at every third position of siRNA shape its efficient RNAi activity," Nucleic Acids Res., 35(4): e27 (2007).
Khodakovskaya et al., "Carbon Nanotubes Are Able to Penetrate Plant Seed Coat and Dramatically Affect Seed Germination and Plant Growth," ACS Nano, 3(10):3221-3227 (2009).
Khovorova et al., "Rational siRNA design for RNA interference," *Nature Biotechnol.*, 22 :326-330 (2004).
Kikkert et al., "Stable Transformation of Plant Cells by Particle Bombardment/Biolistics," Methods in Molecular Biology, 286:61-78 (2005).
Kim et al., "Optimization of Conditions for Transient Agrobacterium-Mediated Gene Expression Assays in *Arabidopsis*," Plant Cell Reports, 28:1159-1167 (2009).
Kim et al., "Synthetic dsRNA Dicer substrates enhance RNAi potency and efficacy," Nature Biotechnology, 23(2):222-226 (2005).
Klahre et al., "High molecular weight RNAs and small interfering RNAs induce systemic posttranscriptional gene silencing in plants," Proc. Natl. Acad. Sci. USA, PNAS, 99(18):11981-11986 (2002).
Kondylis et al., "The Golgi apparatus: Lessons from *Drosophila*," FEBS Letters 583:3827-3838 (2009).
Kronenwett et al., "Oligodeoxyribonucleotide Uptake in Primary Human Hematopoietic Cells Is Enhanced by Cationic Lipids and Depends on the Hematopoietic Cell Subset," Blood, 91(3):852-862 (1998).
Kumar et al., Sequencing, De Novo Assembly and Annotation of the.
Kusaba, "RNA interference in crop plants," Curr Opin Biotechnol, 15(2):139-143 (2004).
Lee et al., "A systematic RNAi screen identifies a critical role for mitochondria in C. elegans longevity." *Nature Genetics*, 33:40-48 (2003).
Lee et al., "Aptamer Database," Nucleic Acids Research, 32:D95-D100 (2004).
Li et al, "RNA interference in *Nilaparvata lugens* (Homoptera:Delphacidae) based on dsRNA ingestion," *Pest Manag. Sci.*, 67:852-859 (2011).
Li et at., "Long dsRNA but not siRNA initiates RNAi in western corn rootworm larvae and adults," Journal of Applied Entomology, 139(6):432-445 (2015).

(56) References Cited

OTHER PUBLICATIONS

Liu et al., "Prevention of Chinese Sacbrood Virus Infection in Apis Cerana Using RNA Interference," Current Microbiology, 61(5):422-428 (2010).
Liu et al., "Carbon Nanotubes as Molecular Transporters for Walled Plant Cells," Nano Letters, 9(3):1007-1010 (2009).
Liu et al., "Comparative study on the interaction of DNA with three different kinds of surfactants and the formation of multilayer films," Bioelectrochemistry, 70:301-307 (2007).
Liu et al., "DNAzyme-mediated recovery of small recombinant RNAs from a 5S rRNA-derived chimera expressed in Escherichia coli," BMC Biotechnology, 10:85 (2010).
Liu et al., "RNA interference in Nilaparvata lugens (Homoptera : Delphacidae) based on dsRNA ingestion," Pest Manag. Sci., 67:852-859 (2011).
Liu, "Influence of Sugars on the Foliar Uptake of Bentazone and Glyphosate," New Zealand Plant Protection, 55:159-162 (2002).
Liu, "The Transformation of Nucleic Acid Degradants in Plants," China Organic Fertilizers, Agriculture Press, ISBN: 7-1091634 (with English translation).
Llave et al., "Endogenous and Silencing-Associated Small RNAs in Plants," The Plant Cell, 14:1605-1619 (2002).
Lu et al., "Oligo Walk: an online siRNA design tool utilizing hybridization thermodynamics," Nucleic Acids Research, 36:W104-W108 (2008).
Lu et al., "RNA silencing in plants by the expression of siRNA duplexes," Nucleic Acids Res., 32(21):e171 (2004).
Luft, "Making sense out of antisense oligodeoxynucleotide delivery: getting there is half the fun," J Mol Med, 76:75-76 (1998).
Luque et al., "Water Permeability of Isolated Cuticular Membranes: A Structural Analysis," Archives of Biochemistry and Biophysics, 317(2):417-422 (1995).
Maas et al., "Mechanism and optimized conditions for PEG mediated DNA transfection into plant protoplasts," Plant Cell Reports, 8:148-149 (1989).
MacKenzie et al., "Transgenic Nicotiana debneyii expressing viral coat protein are resistant to potato virus S infection," Journal of General Virology, 71:2167-2170 (1990).
Maggi et al., "Resistance Phenomena to Amitraz From Population of the Ectoparasitic Mite Varroa Destructor of Argentina," Parasitology Research, 107(5):1189-1192 (2010).
Maher III et al., "Inhibition of DNA binding proteins by oligonucleotide-directed triple helix formation," Science, 245(4919):725-730 (1989).
Makkouk et al., "Virus Diseases of Peas, Beans, and Faba Bean in the Mediterranean region," Adv Virus Res, 84:367-402 (2012).
Manoharan, "Oligonucleotide Conjugates as Potential Antisense Drugs with Improved Uptake, Biodistribution, Targeted Delivery, and Mechanism of Action," Antisense & Nucleic Acid Drug Development, 12:103-128 (2002).
Mao et al., "Silencing a cotton bollworm P450 monooxygenase gene by plant-mediated RNAi impairs larval tolerance of gossypol.," Nat Biotechnol, 25(11):1307-13 (2007).
Maori et al., "Isolation and characterization of Israeli acute paralysis virus, a dicistrovirus affecting honeybees in Israel: evidence for diversity due to intra- and inter-species recombination," Journal of General Virology, 88:3428-3438 (2007).
Maori et al., "Israel Acute Paralysis Virus of Bees, Complete Genome," GenBank EMBL, EBI Dbfetch, XP002533679, Accession No. EF219380, Nov. 21, 2007.
Maori et al., "Reciprocal sequence exchange between non-retro viruses and hosts leading to the appearance of new host phenotypes," Virology, 362(2):342-349 (2007).
Maori et al., "IAPV, a bee-affecting virus associated with Colony Collapse Disorder can be silenced by dsRNA ingestion," Insect Molecular Biology, 18(1):55-60 (2009).
Masoud et al., "Constitutive expression of an inducible β-1,3-glucanase in alfalfa reduces disease severity caused by the oomycete pathogen Phytophthora megasperma f. sp medicaginis, but does not reduce disease severity of chitincontaining fungi," Transge.

Matveeva et al., "Prediction of antisense oligonucleotide efficacy by in vitro methods," Nature Biotechnology, 16:1374-1375 (1998).
McGinnis, "RNAi for functional genomics in plants," Brief Funct Genomics, 9(2):111-7 (2010).
Meins et al., "RNA Silencing Systems and Their Relevance to Plant Development," Annu. Rev. Cell Dev. Biol., 21:297-318 (2005).
Melnyk et al., "Intercellular and systemic movement of RNA silencing signals," The EMBO Journal, 30:3553-3563 (2011).
Migge et al., "Greenhouse-grown conditionally lethal tobacco plants obtained by expression of plastidic glutamine synthetase antisense RNA may contribute to biological safety," Plant Science 153:107-112 (2000).
Molnar et al., "Plant Virus-Derived Small Interfering RNAs Originate redominantly from Highly Structured Single-Stranded Viral RNAs," Journal of Virology, 79(12):7812-7818 (2005).
Molnar et al., "Small Silencing RNAs in Plants Are Mobile and Direct Epigenetic Modification in Recipient Cells," Science, 328:872-875 (2010).
Moriyama et al., "Double-stranded RNA in rice: a novel RNA replicon in plants," Molecular & General Genetics, 248(3):364-369 (1995).
Moriyama et al., "Stringently and developmentally regulated levels of a cytoplasmic double-stranded RNA and its high-efficiency transmission via egg and pollen in rice," Plant Molecular Biology, 31:713-719 (1996).
Morrissey et al., "Potent and persistent in vivo anti-HBV activity of chemically modified siRNAs," Nat Biotechnol. 23(8):1002-1007 (2005).
Moser et al., "Sequence-Specific Cleavage of Double Helical DNA by Triple Helix Formation," Science, 238:645-646 (1987).
Mount et al., "Gene and Metabolite Regulatory Network Analysis of Early Developing Fruit Tissues Highlights New Candidate Genes for the Control of Tomato Fruit Composition and Development," Plant Physiology, 149:1505-1528 (2009).
Nakayashiki et al. "Evolution and Diversification of RNA Silencing Proteins in Fungi", Journal of Molecular Evolution, 63(1):127-135 (2006).
Non-Final Office Action dated Apr. 11, 2013, in U.S. Appl. No. 13/042,856.
Non-Final Office Action dated Apr. 15, 2014, in U.S. Appl. No. 13/446,557.
Non-Final Office Action dated Apr. 29, 2016, in U.S. Appl. No. 13/583,302.
Non-Final Office Action dated Aug. 10, 2016, in U.S. Appl. No. 13/612,995.
Non-Final Office Action dated Aug. 12, 2015, in U.S. Appl. No. 13/612,936.
Non-Final Office Action dated Aug. 13, 2015, in U.S. Appl. No. 13/612,929.
Non-Final Office Action dated Aug. 19, 2016, in U.S. Appl. No. 13/612,925.
Non-Final Office Action dated Aug. 19, 2016, in U.S. Appl. No. 13/612,929.
Non-Final Office Action dated Aug. 3, 2016, in U.S. Appl. No. 14/015,715.
Non-Final Office Action dated Aug. 5, 2016, in U.S. Appl. No. 14/015,785.
Non-Final Office Action dated Aug. 8, 2016, in U.S. Appl. No. 13/612,936.
Non-Final Office Action dated Dec. 17, 2015, in U.S. Appl. No. 14/532,596.
Non-Final Office Action dated Feb. 10, 2016, in U.S. Appl. No. 13/901,326.
Non-Final Office Action dated Feb. 23, 2016, in U.S. Appl. No. 14/603,347.
Non-Final Office Action dated Feb. 23, 2016, in U.S. Appl. No. 14/608,951.
Non-Final Office Action dated Feb. 5, 2014, in U.S. Appl. No. 13/446,557.
Non-Final Office Action dated Jan. 7, 2013, in U.S. Appl. No. 13/318,636.
Non-Final Office Action dated Jul. 23, 2015, in U.S. Appl. No. 14/335,135.

(56) References Cited

OTHER PUBLICATIONS

Non-Final Office Action dated Jul. 30, 2014, in U.S. Appl. No. 13/042,856.
Non-Final Office Action dated Jun. 5, 2015, in U.S. Appl. No. 13/612,948.
Non-Final Office Action dated Jun. 8, 2015, in U.S. Appl. No. 13/612,941.
Non-Final Office Action dated Mar. 1, 2016, in U.S. Appl. No. 13/612,954.
Non-Final Office Action dated Mar. 21, 2018, in U.S. Appl. No. 13/619,980.
Non-Final Office Action dated Mar. 30, 2015, in U.S. Appl. No. 13/583,302.
Non-Final Office Action dated May 15, 2015, in U.S. Appl. No. 14/608,951
Non-Final Office Action dated May 22, 2015, in U.S. Appl. No. 13/612,985.
Non-Final Office Action dated May 30, 2012, in U.S. Appl. No. 13/332,430.
Non-Final Office Action dated May 4, 2015, in U.S. Appl. No. 13/932,051.
Non-Final Office Action dated Nov. 9, 2016, in U.S. Appl. No. 14/901,003.
Non-Final Office Action dated Oct. 3, 2016, in U.S. Appl. No. 14/403,491.
Non-Final Office Action dated Sep. 1, 2015, in U.S. Appl. No. 13/612,954.
Non-Final Office Action dated Sep. 11, 2015, in U.S. Appl. No. 13/612,925.
Non-Final Office Action dated Sep. 23, 2010, in U.S. Appl. No. 12/222,949.
Non-Final Office Action dated Sep. 4, 2015, in U.S. Appl. No. 13/612,995.
Non-Final Office Action dated Sep. 6, 2016, in U.S. Appl. No. 14/335,135.
Nookaraju et al., "Molecular approaches for enhancing sweetness in fruits and vegetables," Scientia Horticulture, 127:1-15 (2010).
Nord-Larsen et al., "Cloning, characterization and expression analysis of tonoplast intrinsic proteins and glutamine synthetase in ryegrass (Lolium perenne L.)," Plant Cell Reports, 28(10):1549-1562 (2009).
Nowak et al., "A new and efficient method for inhibition of RNA viruses by DNA interference," The FEBS Journal, 276:4372-4380 (2009).
Nunes et al., "A non-invasive method for silencing gene transcriptoin in honeybees maintained under natural conditions," Insect Biochemistry and Molecular Biology, 39:157-160 (2009).
Office Action dated 2015, in Chinese Patent Application No. 201080056585.9.
Office Action dated Apr. 13, 2016, in Chinese Patent Application No. 201280053985.3.
Office Action dated Apr. 15, 2014, in U.S. Appl. No. 13/446,557.
Office Action dated Aug. 1, 2013, in U.S. Appl. No. 13/318,636.
Office Action dated Aug. 1, 2017, in European Patent Application No. 12 830 932.5.
Office Action dated Aug. 14, 2017, in Israeli Patent Application No. 235878.
Office Action dated Aug. 22, 2017, in Korean Patent Application No. 10-2012-7023415.
Office Action dated Aug. 25, 2015, in New Zealand Patent Application No. 700791.
Office Action dated Aug. 25, 2016, in Eurasian Patent Application No. 201201264.
Office Action dated Aug. 28, 2013, in Chinese Patent Application No. 201180012795.2.
Office Action dated Aug. 3, 2015, in Chinese Patent Application No. 201080056585.9 (English translation attached).
Office Action dated Aug. 3, 2017, in Chinese Patent Application No. 201480014392.5 (with English translation).
Office Action dated Aug. 3, 2017, in European Patent Application No. 12 831 684.1.
Office Action dated Aug. 8, 2017, in Chilean Patent Application No. 201501874.
Office Action dated Dec. 13, 2016, in Ukrainian Patent Application No. a 2014 03843.
Office Action dated Dec. 14, 2016, in Ukrainian Patent Application No. a 2014 03850.
Office Action dated Dec. 15, 2016, in Ukrainian Patent Application No. a 2014 03845.
Office Action dated Dec. 15, 2016, in Ukrainian Patent Application No. a 2014 03849.
Office Action dated Dec. 15, 2016, in Ukrainian Patent Application No. a 2014 03852.
Office Action dated Dec. 18, 2014, in Israeli Patent Application No. 216154 (with English translation).
Office Action dated Dec. 21, 2015, in Israeli Patent Application No. 240416 (with English translation).
Office Action dated Dec. 27, 2016, in Ukrainian Patent Application No. a 2012 11548.
Office Action dated Dec. 31, 2014, in Israeli Patent Application No. 205594 (with English translation).
Office Action dated Dec. 5, 2017, in Japanese Patent Application No. 2016-502033.
Office Action dated Feb. 17, 2011, in European Patent Application No. 08847971.2.
Office Action dated Feb. 17, 2014, in European Patent Application No. 08847971.2.
Office Action dated Feb. 17, 2014, in Mexican Patent Application No. MX/a/2012/010479.
Office Action dated Feb. 21, 2018, in Mexican Patent Application No. MX/a/2015/012632 (with English translation).
Office Action dated Feb. 24, 2014, in Eurasian Patent Application No. 201201264.
Office Action dated Feb. 5, 2015, in European Patent Application No. 13156183.9.
Office Action dated Feb. 6, 2015, in European Patent Application No. 10719620.6.
Office Action dated Jan. 19, 2014, in Israeli Patent Application No. 205594 (with English translation).
Office Action dated Jan. 26, 2015, in Israeli Patent Application No. 205594 (with English translation).
Office Action dated Jan. 26, 2015, in Israeli Patent Application No. 219193 (with English translation).
Office Action dated Jan. 30, 2015, in Mexican Patent Application No. MX/a/2012/004378 (with English translation).
Office Action dated Jan. 7, 2013, in U.S. Appl. No. 13/318,636.
Office Action dated Jul. 11, 2017, in Mexican Patent Application No. MX/a/2015/013118 (with English translation).
Office Action dated Jul. 12, 2013, in European Patent Application No. 08847971.2.
Office Action dated Jul. 18, 2016, in Indonesian Patent Application No. W00201203610.
Office Action dated Jul. 2, 2013, in Chinese Patent Application No. 201080056585.9.
Office Action dated Jul. 23, 2015, in Ukrainian Patent Application No. 201211548.
Office Action dated Jul. 3, 2017, in Mexican Patent Application No. MX/a/2015/012632 (with English translation).
Office Action dated Jul. 6, 2017, in Mexican Patent Application No. MX/a/2015/013103 (with English translation).
Office Action dated Jun. 29, 2012, in European Patent Application No. 08847971.2.
Office Action dated Jun. 20, 2016, in Chinese Patent Application No. 201280054819.5.
Office Action dated Jun. 24, 2016, in Chinese Patent Application No. 201280053984.9.
Office Action dated Jun. 28, 2010, in U.S. Appl. No. 12/222,949.
Office Action dated Jun. 8, 2015, in European Patent Application No. 13156185.4.
Office Action dated Mar. 10, 2014, in European Patent Application No. 13156180.4.

(56) References Cited

OTHER PUBLICATIONS

Office Action dated Mar. 10, 2014, in European Patent Application No. 13156180.5.
Office Action dated Mar. 16, 2017, in Chinese Patent Application No. 201280054819.5.
Office Action dated Mar. 17, 2014, in European Patent Application No. 13156183.9.
Office Action dated Mar. 18, 2011, in U.S. Appl. No. 12/222,949.
Office Action dated Mar. 19, 2012, in Israeli Patent Application No. 205594 (English Translation attached).
Office Action dated Mar. 19, 2015, in Canadian Patent Application No. 2,704,858.
Office Action dated Mar. 20, 2015, in Indian Patent Application No. 1150/MUMNP/2010.
Office Action dated Mar. 8, 2018 (with English translation), in Chilean Patent Application No. 201403192.
Office Action dated May 12, 2014, in Chinese Patent Application No. 201080056585.9.
Office Action dated May 12, 2014, in Mexican Patent Application No. MX/a/2012/004378 (English Translation attached).
Office Action dated May 29, 2015, in European Patent Application No. 13156180.4.
Office Action dated May 29, 2015, in European Patent Application No. 13156180.5.
Office Action dated May 3, 2016, in Chilean Patent Application No. 201601057.
Office Action dated May 30, 2012, in U.S. Appl. No. 13/332,430.
Office Action dated Nov. 10, 2014, in European Patent Application No. 10779855.5.
Office Action dated Nov. 15, 2016, in Mexican Patent Application No. MX/a/2014/003068 (with English translation).
Office Action dated Nov. 21, 2012, in U.S. Appl. No. 13/318,636.
Office Action dated Nov. 6, 2014, in Australian Patent Application No. 2010244122.
Office Action dated Oct. 15, 2012, in U.S. Appl. No. 13/332,430.
Office Action dated Oct. 21, 2015, in European Patent Application No. 13723252.6.
Office Action dated Oct. 23, 2013, in Australian Patent Application No. 2008325989.
Office Action dated Oct. 31, 2013 , , in Mexican Patent Application No. MX/a/2012/004378 (English Translation attached).
Office Action dated Oct. 31, 2013, in Mexican Patent Application No. MX/a/2012/004378.
Office Action dated Oct. 8, 2013, in European Patent Application No. 10719620.6.
Office Action dated Sep. 29, 2014, European Patent Application No. 13156180.4.
Office Action dated Sep. 29, 2014, in European Patent Application No. 13156180.5.
Office Action dated Sep. 1, 2015, in European Patent Application No. 10779855.5.
Office Action dated Sep. 23, 2010, in U.S. Appl. No. 12/222,949.
Office Action dated Sep. 28, 2015, in U.S. Appl. No. 13/932,051.
Office Action dated Sep. 29, 2014, in European Patent Application No. 13156180.4.
Office Action dated Sep. 4, 2015, in European Patent Application No. 13156183.9.
Office Action dated Sep. 5, 2016, in Ukrainian Patent Application No. a 2014 03846.
Office Action dated Sep. 6, 2017, in Chinese Patent Application No. 2014800154012 (with English translation).
Office Action dated Nov. 3, 2014, in Chinese Patent Application No. 201180012795.2.
Office Action dated Jan. 6, 2015, in Japanese Patent Application No. 2012-557165.
Office Action dated Nov. 19, 2014, in Eurasian Patent Application No. 201201264/28.
Office Action dated Oct. 5, 2015, in Eurasian Patent Application No. 201201264/28.

Ongvarrasopone et al., "A Simple and Cost Effective Method to Generate dsRNA for RNAi Studies in Invertebrates," Science Asia, 33:35-39 (2007).
Orbović et al., "Foliar-Applied Surfactants and Urea Temporarily Reduce Carbon Assimilation of Grapefruit Leaves," J. Amer. Soc. Hort. Sci., 126(4):486-490 (2001).
Ouellet et al., "Members of the Acetohydroxyacid Synthase Muligene Family of *Brassica napus* Have Divergent Patterns of Expression," The Plant Journal, Blackwell Scientific Publications, Oxford, GB, 2(3):321-330 (1992).
Paddison et al., "Stable suppression of gene expression by RNAi in mammalian cells," Proc. Natl Acad. Sci. USA, 99(3):1443-1448 (2002).
Palacios et al., "Genetic Analysis of Israel Acute Paralysis Virus: Distinct Clusters Are Circulating in the United States," *Journal of Virology*, 82(13):6209-6217 (2008).
Palauqui et al., "Activation of systemic acquired silencing by localised introduction of DNA," Current Biology, 9:59-66 (1999).
Paldi et al. "Effective Gene Silencing in a Microsporidian Parasite Associated With Honeybee (*Apis mellifera*) Colony Declines", Applied and Environmental Microbiology, 760(17):5960-5964 (2010).
Parera et al., "Dehydration Rate after Solid Matrix Priming Alters Seed Performance of Shrunken-2 Corn," J. Amer. Soc. Hort. Sci., 119(3):629-635 (1994).
Partial European Search Report dated Dec. 6, 2017, in European Patent Application No. 17181861.0.
Partial International Search Report dated Jul. 24, 2013, International Application No. PCT/2013/050321.
Partial International Search Report dated May 13, 2009, in International Application No. PCT/IL2008/001440.
Partial Supplementary European Search Report dated Mar. 2, 2015, in European Patent Application No. 12 831 494.5.
Partial Supplementary European Search Report dated Jan. 11, 2018, in European Patent Application No. 15812530.0.
Patent Examination Report dated Nov. 6, 2014, in Australian Patent Application No. 2010244122.
Patent Examination Report dated Oct. 23, 2013, in Australian Patent Application No. 2008325989.
Patent Examination Report No. 1 dated Feb. 8, 2016, in Australian Patent Application No. 2014262189.
Patent Examination Report No. 1 dated Jun. 17, 2016, in Australian Patent Application No. 2012308659.
Patent Examination Report No. 1 dated Jun. 17, 2016, in Australian Patent Application No. 2012308660.
Patent Examination Report No. 1 dated Jun. 8, 2017, in Australian Patent Application No. 2012308686.
Patent Examination Report No. 1 dated Nov. 11, 2013, in Australian Patent Application No. 2011224570.
Paungfoo-Lonhienne et al., "DNA is Taken up by Root Hairs and Pollen, and Stimulates Root and Pollen Tube Growth," Plant Physiology, 153:799-805 (2010).
Paungfoo-Lonhienne et al., "DNA uptake by *Arabidopsis* induces changes in the expression of CLE peptides which control root morphology," Plant Signaling & Behavior, 5(9):1112-1114 (2010).
Pei et al., "On the art of identifying effective and specific siRNAs," Nature Methods, 3(9):670-676 (2006).
Peretz et al., "A Universal Expression/Silencing Vector in Plants," Plant Physiology, 145:1251-1263 (2007).
Pitino et al., "Silencing of Aphid Genes by dsRNA Feeding from Plants," *PLos One*, 6:e25709 (2011).
Pornprom et al., "Glutamine synthetase mutation conferring target-site-based resistance to glufosinate in soybean cell selections," Pest Manag Sci, 2009; 65(2):216-222 (2009).
Powles et al., "Evolution in Action: Plants Resistant to Herbicides," Annual Review of Plant Biology, 61(1):317-347 (2010).
Pratt et al., "Amaranthus rudis and A. tuberculatus, One Species or Two?," Journal of the Torrey Botanical Society, 128(3):282-296 (2001).
Preston et al., "Multiple effects of a naturally occurring proline to threonine substitution within acetolactate synthase in two herbicide-resistant populations of Lactuca serriola," Pesticide Biochem. Physiol., 84(3):227-235 (2006).

(56) References Cited

OTHER PUBLICATIONS

Price et al. "RNAi-Mediated Crop Protection Against Insects", Trends in Biotechnology, XP022757296, 26(7):393-400 (2008).
Pridgeon et al., "Topically Applied AaeIAP1 Double-Stranded RNA Kills Feman Adults of *Aedes aegypti,*" *J. Med. Entomol.*, 45(3):414-420 (2008).
Rajur et al., "Covalent Protein—Oligonucleotide Conjugates for Efficient Delivery of Antisense Molecules," Bioconjug Chem., 8:935-940 (1997).
Rakoczy-Trojanowska, "Alternative Methods of Plant Transformation—a short review," Cellular & Molecular Biology Letters, 7:849-858 (2002).
Reddy et al "Organosilicone Adjuvants Increased the Efficacy of Glyphosate for Control of Weeds in Citrus (*Citrus* spp.)" HortScience 27(9):1003-1005 (1992).
Reddy et al., "Aminomethylphosphonic Acid Accumulation in Plant Species Treated with Glyphosate," J. Agric. Food Chem., 56(6):2125-2130 (2008).
Reither et al., "Specificity of DNA triple helix formation analyzed by a FRET assay," BMC Biochemistry, 3:27 (2002).
Requisition by the Examiner and Examination Search Report dated Mar. 19, 2015, in Canadian Patent Application No. 2,704,858.
Rey et al., "Diversity of Dicotyledenous-Infecting Geminiviruses and Their Associated DNA Molecules in Southern Africa, Including the South-West Indian Ocean Islands," Viruses, 4:1753-1791 (2012).
Reynolds et al., "Rational siRNA design for RNA interference," Nature Biotechnology, 22:326-330 (2004).
Richardson et al., "Targeting and assembly of components of the TOC protein import complex at the chloroplast outer envelope membrane," Frontiers in Plant Science, 5:1-14 (2014).
Riggins et al., "Characterization of de novo transcriptome for waterhemp (*Amaranthus tuberculatus*) using GS-FLX 454 pyrosequencing and its application for studies of herbicide target-site genes," Pest Manag. Sci., 66:1042-1052 (2010).
Robalino et al., "Double-Stranded RNA and Antiviral Immunity in Marine Shrimp: Inducible Host Mechanisms and Evidence for the Evolution of Viral Counter-Responses," Developmental & Comparative Immunology, 31: 539-547 (2007).
Roberts, "Fast-track applications: The potential for direct delivery of proteins and nucleic acids to plant cells for the discovery of gene function," Plant Methods, 1(12):1-3 (2005).
Rose et al., "Functional polarity is introduced by Dicer processing of short substrate RNAs," Nucleic Acids Research, 33(13):4140-4156 (2005).
Rothnie et al., Pararetroviruses and Retroviruses: A Comparative Review of Viral Structure and Gene Expression Strategies, Advances in Virus Research, 44:1-67 (1994).
Ryabov et al., "Cell-to-Cell, but Not Long-Distance, Spread of RNA Silencing That Is Induced in Individual Epidermal Cells," Journal of Virology, 78(6):3149-3154 (2004).
Salanenka et al., "Seedcoat Permeability: Uptake and Postgermination Transport of Applied Model Tracer Compounds," HortScience, 46(4):622-626 (2011).
Santoro et al., "A general purpose RNA-cleaving DNA enzyme," *Proc. Natl. Acad. Sci. USA*, 94:4262-4266 (1997).
Santosh et al., "RNA interference for the control of whiteflies (*Bemisia tabaci*) by oral route," Journal of Biosciences, 36(1):153-161 (2011).
Sathasivan et al., "Nucleotide sequence of a mutant acetolactate synthase gene from an imidazolinone-resistant *Arabidopsis thaliana* var. *columbia*," Nucleic Acids Research, 18(8):2188-2193 (1990).
Schönherr, "Water Permeability of Isolated Cuticular Membranes: The Effect of pH and Cations on Diffusion, Hydrodynamic Permeability and Size of Polar Pores in the Cutin Matrix," Planta, 128:113-126 (1976).
Schwab et al., "RNA silencing amplification in plants: Size matters," PNAS, 107(34):14945-14946 (2010).
Schweizer et al., "Double-stranded RNA interferes with gene function at the single-cell level in cereals," The Plant Journal, 24(6):895-903 (2000).
Scott et al., "Towards the elements of successful insect RNAi," Journal of Insect Physiology, 59(12):1212-1221 (2013).
Scott et al., Botanical Insecticides for Controlling Agricultural Pests: Piperamides and the Colorado Potato Beetle *Leptinotarsa decemlineata* Say (Coleoptera: Chrysomelidae), Archives of Insect Biochemistry and Physiology, 54:212-225 (2003).
Search Report dated Jul. 24, 2017, in Chinese Patent Application No. 201480014392.5 (with English translation).
Search Report dated Oct. 20, 2017, in Chinese Patent Application No. 201380039346.6.
Second Chinese Office Action dated Jun. 10, 2014, in Chinese Patent Application No. 201180012795.2.
Second Office Action dated Feb. 25, 2016, in Chinese Patent Application No. 201280054179.8.
Second Office Action dated Mar. 4, 2016, in Chinese Patent Application No. 201280054820.8.
Second Office Action dated May 12, 2014, in Chinese Patent Application No. 201080056585.9.
Seidman et al., "The potential for gene repair via triple helix formation," J Clin Invest., 112(4):487-494 (2003).
Selvarani et al., "Evaluation of seed priming methods to improve seed vigour of onion (*Allium cepa* cv. Aggregatum) and carrot (*Daucus carota*)," Journal of Agricultural Technology, 7(3):857-867 (2011).
Senthil-Kumar et al., "A systematic study to determine the extent of gene silencing in Nicotiana benthamiana and other *Solanaceae* species when heterologous gene sequences are used for virus-induced gene silencing," New Phytologist, 176:782-791 (2007).
Sharma et al., "A simple and efficient Agrobacterium-mediated procedure for transformation of tomato," J. Biosci., 34(3):423 433 (2009).
Shen et al., "The Role of Varroa Mites in Infections and Deformed Wing Virus (DWV) in Honey," Available Online Aug. 18, 2005.
Shintani et al., "Antisense Expression and Overexpression of Biotin Carboxylase in Tobacco Leaves," Plant Physiol., 114:881-886 (1997).
Showalter, "Structure and Function of Plant Cell Wall Proteins," The Plant Cell, 5:9-23 (1993).
Sijen et al., "On the Role of RNA Amplification in dsRNA-Triggered Gene Silencing," Cell, 107:465-476 (2001).
Silwet L-77 Spray Adjuvant for agricultural applications, product description from Momentive Performance Materials, Inc. (2003).
Sindhu et al., "Effective and specific in planta RNAi in cyst nematodes: expression interference of four parasitism genes reduces parasitic success," *J. Exp. Botany*, 60:315-324 (2008).
Siomi et al. "On the Road to Reading the RNA-Interference Code", Nature, 457(7228): 396-404, Jan. 22, 2009. Abstract.
Slamovits et al. "Genome Compaction and Stability in Microsporidian Intracellular Parasites", Current Biology, 14(10): 891-896, May 25, 2004.
Small, "RNAi for revealing and engineering plant gene functions," Current Opinion in Biotechnology, 18:148-153 (2007).
Snead et al., "Molecular basis for improved gene silencing by Dicer substrate interfering RNA compared with other siRNA variants," Nucleic Acids Research, 41(12):6209-6221 (2013).
Soares et al., "Capillary feeding of specific dsRNA induces silencing of the isac gene in nymphal lxodes scapularis ticks," Insect Mol. Biol., 14(4):443-452 (2005).
Song et al., "Herbicide," New Heterocyclic Pesticide, Chemical Industry Press, 354-356 (2011).
Standifer et al., "Supplemental Feeding of Honey Bee Colonies," *Agriculture Information Bullentin No. 413*, USDA, pp. 1-8 (1977).
Statement of Grounds and Particulars dated Sep. 1, 2017, in Australian Patent No. 2014262189.
Steeves et al., "Transgenic soybeans expressing siRNAs specific to a major sperm protein gene suppress Heterodera glycines reproduction," Funct. Plant Biol., 33:991-999 (2006).
Stevens et al., "New Formulation Technology—Silwet® Organosilicone Surfactants Have Physical and Physiological Properties Which Enhance the Performance of Sprays," Proceedings of the 9th Australian Weeds Conference, pp. 327-331 (1990).
Stevens, "Formulation of Sprays to Improve the Efficacy of Foliar Fertilisers," New Zealand Journal of Forestry Science, 24(1):27-34 (1994).

(56) References Cited

OTHER PUBLICATIONS

Stevens, "Organosilicone Surfactants as Adjuvants for Agrochemicals," Journal of Pesticide Science, 38:103-122 (1993).
Stock et al., "Possible Mechanisms for Surfactant-Induced Foliar Uptake of Agrochemicals," Pestic. Sci., 38:165-177 (1993).
Strat et al., "Specific and nontoxic silencing in mammalian cells with expressed long dsRNAs," Nucleic Acids Research, 34(13):3803-3810 (2006).
Street, "Why is DNA (and not RNA) a stable storage form for genetic information?," Biochemistry Revisited, pp. 1-4 (2008).
Sudarsan et al., "Metabolite-binding RNA domains are present in the genes of eukaryotes," RNA, 9:644-647 (2003).
Summons to Attend Oral Proceedings Pursuant to Rule 115(1) EPC, dated Aug. 7, 2017, in European Patent Application No. 12832160.1.
Sun, "Characterization of Organosilicone Surfactants and Their Effects on Sulfonylurea Herbicide Activity," Thesis Submitted to the Faculty of the Virginia Polytechnic Institute and State University dated Apr. 5, 1996.
Supplementary European Search Report dated Jan. 17, 2018, in European Patent Application No. 15773480.7.
Supplementary Partial European Search Report dated Jan. 11, 2018 in European Appln. 15 82 6865.
Supplementary Partial European Search Report dated Oct. 16, 2017, in European Patent Application No. 15773480.7.
Takasaki et al., "An Effective Method for Selecting siRNA Target Sequences in Mammalian Cells," Cell Cycle, 3:790-795 (2004).
Tang et al., "Efficient delivery of small interfering RNA to plant cells by a nanosecond pulsed laser-induced stress wave for post-transcriptional gene silencing," Plant Science, 171:375-381 (2006).
Tank Mixing Chemicals Applied to Peanut Crops: Are the Chemicals Compatible?, College of Agriculture & Life Sciences, NC State University, AGW-653, pp. 1-11 (2004).
Templeton et al., "Improved DNA: liposome complexes for increased systemic delivery and gene expression," Nature Biotechnology, 15:647-652 (1997).
Tenllado et al., "Crude extracts of bacterially expressed dsRNA can be used to protect plants against virus infection," BMC Biotechnology, 3(3):1-11 (2003).
Tenllado et al, "Double-Stranded RNA-Mediated Interference with Plant Virus Infection," Journal of Virology, 75(24):12288-12297 (2001).
Tenllado et al., "RNA interference as a new biotechnological tool for the control of virus diseases in plants," Virus Research, 102:85-96 (2004).
Tepfer, "Risk assessment of virus resistant transgenic plants," Annual Review of Phytopathology, 40:467-491 (2002).
Terenius et al., RNA interference in Lepidoptera: an overview of successful and unsuccessful studies and implications for experimental design, Journal of Insect Physiology, 57(2):231-245 (2011).
Third Office Action dated Nov. 25, 2014, in Chinese Patent Application No. 201080056585.9.
Third Party Submission filed on Nov. 29, 2012 in U.S. Appl. No. 13/042,856.
Thomas et al., "Size constraints for targeting post-transcriptional gene silencing and for RNA-directed methylation in Nicotiana benthamiana using a potato virus X vector," The Plant Journal, 25(4):417-425 (2001).
Tian et al., "Developmental Control of a Lepidopteran Pest *Spodoptera exigua* by Ingestion of Bacteria Expressing dsRNA of a Non-Midgut Gene," PLoS One, 4:e6225, pp. 1-14 (2009).
Timmons et al., "Specific interference by ingested dsRNA," Nature, 395:854 (1998).
Tomari et al., "Perspective: machines for RNAi," Genes & Dev., 19:517-529 (2005).
Töpfer et al., "Uptake and Transient Expression of Chimeric Genes in Seed-Derived Embryos," Plant Cell, 1:133-139 (1989).
Toriyama et al., "Transgenic Rice Plants After Direct Gene Transfer Into Protoplasts," Bio/Technology, 6:1072-1074 (1988).
Tran et al., "Control of specific gene expression in mammalian cells by co-expression of long complementary RNAs," FEBS Lett.;573(1-3):127-134 (2004).
Tranel et al., "Resistance of weeds to ALS-inhibiting herbicides: what have we learned?," Weed Science, 50:700-712 (2002).
Translation dated Jan. 15, 2015 of Office Action dated Dec. 18, 2014 From the Israel Patent Office Re. Application No. 216154.
Translation dated Jan. 20, 2015 of Office Action dated Dec. 31, 2014 From the Israel Patent Office Re. Application No. 205594.
Translation of Office Action dated Jul. 2, 2013 From the State Intellectual Property Office of the People's Republic of China Re. Application No. 201080056585.9.
Tsugawa et al., "Efficient transformation of rice protoplasts mediated by a synthetic polycationic amino polymer," Theor Appl Genet, 97:1019-1026 (1998).
Turina et al., "Tospoviruses in the Mediterranean Area," Advances in Virus Research, 84:403-437 (2012).
Turner et al., "RNA interference in the light brown apple moth, *Epiphyas postvittana* (Walker) induced by double-stranded RNA feeding," Insect Mol. Biol., 15(3):383-391 (2006).
Tuschl, "Expanding small RNA interference," Nature Biotechnol., 20: 446-448 (2002).
Tuschl, "RNA Interference and Small Interfering RNAs," ChemBiochem. 2(4):239-245 (2001).
Ui-Tei et al., "Guidelines for the selection of highly effective siRNA sequences for mammalian and chick RNA interference," Nucleic Acids Res., 32(3): 936-948 (2004).
Ullu et al., "RNA Interference in Protozoan Parasites," *Cellular Microbiology*, 6(6):509-519 (2004).
Ulrich et al., "Large scale RNAi screen in Tribolium reveals novel target genes for pest control and the proteasome as prime target," BMC genomics, 16(1):671 (2015).
Unnamalai et al., "Cationic oligopeptide-mediated delivery of dsRNA for post-transcriptional gene silencing in plant cells," FEBS Letters, 566:307-310 (2004).
Unniraman et al., "Alternate Paradigm for Intrinsic Transcription Termination in Eubacteria," The Journal of Biological Chemistry, 276(45)(9):41850-41855 (2001).
Unniraman et al., "Conserved Economics of Transcription Termination in Eubacteria," Nucleic Acids Research, 30(3):675-684 (2002).
Upadhyay et al., RNA interference for the control of whiteflies (*Bemisia tabaci*) by oral route, J. Biosci., 36(1):153-161 (2011).
Urayama et al., "Knock-down of OsDCL2 in Rice Negatively Affects Maintenance of the Endogenous dsRNA Virus, Oryza sativa Endornavirus," Plant and Cell Physiology, 51(1):58-67 (2010).
Van de Wetering et al., "Specific inhibition of gene expression using a stably integrated, inducible small-interfering-RNA vector," EMBO Rep., 4(6):609-615 (2003).
Vasil et al., "Herbicide Resistant Fertile Transgenic Wheat Plants Obtained by Microprojectile Bombardment of Regenerable Embryogenic Callus," Bio/Technology,10:667-674 (1992).
Vaucheret, "Post-transcriptional small RNA pathways in plants: mechanisms and regulations," Genes Dev., 20:759-771 (2006).
Vencill et al., "Resistance of Weeds to Herbicides," Herbicides and Environment, 29:585-594 (2011).
Verma et al., "Modified oligonucleotides: synthesis and strategy for users," Annu. Rev. Biochem., 67:99-134 (1998).
Vermeulen et al., "The contributions of dsRNA structure to Dicer specificity and efficiency," RNA, 11(5):674-682 (2005).
Vert et al., "An accurate and interpretable model for siRNA efficacy prediction," BMC Bioinformatics, 7:520 (2006).
Voinnet et al., "Systemic Spread of Sequence-Specific Transgene RNA Degradation in Plants Is Initiated by Localized Introduction of Ectopic Promoterless DNA," Cell, 95:177-187 (1998).
Voinnet, "Origin, Biogenesis, and Activity of Plant MicroRNAs," Cell, 136:669-687 (2009).
Wakelin et al., "A target-site mutation is present in a glyphosate-resistant Lolium rigidum population," Weed Res. (Oxford), 46(5):432-440 (2006).
Walton et al., "Thermodynamic and Kinetic Characterization of Antisense Oligodeoxynucleotide Binding to a Structured mRNA," *Biophysical Journal*, 82:366-377 (2002).

(56) References Cited

OTHER PUBLICATIONS

Walton et al., "Prediction of antisense oligonucleotide binding affinity to a structured RNA target," Biotechnol Bioeng 65(1):1-9 (1999).
Wan et al., "Generation of Large Numbers of Independently Transformed Fertile Barley Plants," Plant Physiol., 104:37-48 (1994).
Wang et al. "Molecular Characterization of an Arachnid Sodium Channel Gene From the Varroa Mite (*Varroa destructor*)", Insect Biochemistry and Molecular Biology, XP002621492, 33(7): 733-739, Jul. 2003. Abstract.
Wang et al. "Tracking Anonymous Peer-to-Peer VoIP Calls on the Internet", ACM, CCS'05, Alexandria, VA, USA, Nov. 7-11, 2005, 11 P., 2005.
Wang et al., "Foliar uptake of pesticides—Present status and future challenge," ScienceDirect, 87:1-8 (2007).
Wang et al., "Principle and technology of genetic engineering in plants," in Plant genetic engineering principles and techniques, Beijing:Science Press, pp. 313-315 (1998).
Wang et al.,"Silkworm Coatomers and Their Role in Tube Expansion of Posterior Silkgland," *PLoS One* 5(10): E133252 (2010).
Wardell, "Floral Induction of Vegetative Plants Supplied a Purified Fraction of Deoxyribonucleic Acid from Stems of Flowering Plants," Plant Physiol, 60:885-891 (1977).
Wardell,"Floral Activity in Solutions of Deoxyribonucleic Acid Extracted from Tobacco Stems," Plant Physiol, 57:855-861 (1976).
Waterhouse et al., "Virus resistance and gene silencing in plants can be induced by simultaneous expression of sense and antisense RNA," Proc Natl Acad Sci USA, 95 13959-13964 (1998).
Welch et al., "Expression of ribozymes in gene transfer systems to modulate target RNA levels," Curr Opin Biotechnol. 9(5):486-496 (1998).
Whyard et al., "Ingested double-stranded RNAs can act as species-specific insecticides," *Insect Biochem. Mol. Biol.*, 39(11):824-832 (2009).
Widholm et al., "Glyphosate selection of gene amplification in suspension cultures of 3 plant species," Phyisologia Plantarum, 112:540-545 (2001).
Wiesman et al., "Novel cationic vesicle platform derived from vernonia oil for efficient delivery of DNA through plant cuticle membranes," Journal of Biotechnology, 130:85-94 (2007).
Wild Carrot, Noxious Weed Control Board (NWCB) of Washington State (2010) <www.nwcb.wa.gov/detail.asp?weed=46>.
Williams "Unique Physiology of Host-Parasite Interactions in Microsporidia Infections," *Cellular Microbiology*, 11(11):1551-1560 (2009).
Williams et al., "Genome Sequence Surveys of Brachiola Algerae and Edhazardia Aedis Reveal Micriosporidia With Low Gene Densities," *BMC Genomics*, 9(200):1-9 (2008).
Wilson, et al., "Transcription termination at intrinsic terminators: The role of the RNA hairpin," Proc. Natl. Acad. Sci. USA, 92:8793-8797 (1995).
Winkler et al., "Thiamine derivatives bind messenger RNAs directly to regulate bacterial gene expression," Nature, 419:952-956 (2002).
Written Opinion dated Apr. 7, 2016, in Singapore Patent Application No. 201206152-9.
Written Opinion dated Aug. 13, 2009, in International Application No. PCT/IL2008/001440.
Written Opinion dated Mar. 6, 2017, in Singaporean Patent Application No. 2012061529.
Written Opinion dated May 8, 2014, in International Application No. PCT/IL2013/050447.
Written Opinion dated Sep. 1, 2014, in Singapore Patent Application No. 201206152-9.
Yadav et al., "Host-Generated Double Stranded RNA Induces RNAi in Plant-Parasitic Nematodes and Protects the Host From Infection," *Molecular & Biochemical Parasitology*, 148:219-222 (2006).
Yao et al., "Development of RNAi Methods for *Peregrinus maidis*, the Corn Planthopper," PLOS One, 8(8):1-11 (2013).
Yin et al., "Production of double-stranded RNA for interference with TMV infection utilizing a bacterial prokaryotic expression system," Appl. Microbiol. Biotechnol., 84(2):323-333 (2009).
YouTube video by General Electric Company "Silwet Surfactants," screen shot taken on Jan. 11, 2012 of video of www.youtube.com/watch?v=WBw7nXMqHk8 (uploaded Jul. 13, 2009).
Zhang et al., "Agrobacterium-mediated transformation of *Arabidopsis thaliana* using the floral dip method," Nature Protocols, 1(2):1-6 (2006).
Zhang et al., "Cationic lipids and polymers mediated vectors for delivery of siRNA," Journal of Controlled Release, 123:1-10 (2007).
Zhang et al., "Transgenic rice plants produced by electroporation-mediated plasmid uptake into protoplasts," The Plant Cell Rep., 7:379-384 (1988).
Zhang, "Artificial trans-acting small interfering RNA: a tool for plant biology study and crop improvements," Planta, 239:1139-1146 (2014).
Zhang, Chapter 10: New Characteristics of Pesticide Research & Development, p. 209 (2010).
Zhao et al., "Phyllotreta striolata (Coleoptera: Chrysomelidae):Arginine kinase cloning and RNAi-based pest control," European Journal of Entomology, 105(5):815-822 (2008).
Zhao et al., "PsOr1, a potential target for RNA interference-based pest management," *Insect Molecular Biology* 20(1):97-104 (2011).
Zhu et al., "Ingested RNA interference for managing the populations of the Colorado potato beetle, *Leptinotarsa decemlineata*," Pest Manag Sci, 67:175-182 (2010).
Zotti et al., "RNAi technology for insect management and protection of beneficial insects from diseases: lessons, challenges and risk assessments," Neotropical Entomology, 44(3):197-213 (2015).

\* cited by examiner

US 10,378,012 B2

COMPOSITIONS AND METHODS FOR CONTROLLING INSECT PESTS

CROSS-REFERENCE TO RELATED APPLICATIONS AND INCORPORATION OF SEQUENCE LISTINGS

This application is a U.S. National Stage of International Application No. PCT/US2015/042415, filed Jul. 28, 2015, which claims priority to U.S. Provisional Patent Application Ser. No. 62/030,430, filed Jul. 29, 2014, which is incorporated by reference in its entirety herein. A sequence listing contained in the file named "P34170US02.txt" which is 2,153,023 bytes in size (measured in MS-Windows®) and created on Jan. 27, 2017, is filed electronically herewith and incorporated by reference in its entirety.

FIELD

Disclosed herein are methods for controlling invertebrate pest infestations, particularly in plants, compositions and polynucleotides useful in such methods, and plants having improved resistance to the invertebrate pests. More specifically, polynucleotides and methods of use thereof for modifying the expression of genes in an insect pest, particularly through RNA interference are disclosed. Pest species of interest include flea beetles, such as *Phyllotreta* spp. and *Psylliodes* spp.

BACKGROUND

Commercial crops are often the targets of attack by invertebrate pests such as insects. Compositions for controlling insect infestations in plants have typically been in the form of chemical insecticides. However, there are several disadvantages to using chemical insecticides. For example, chemical insecticides are generally not selective, and applications of chemical insecticides intended to control insect pests in crop plants can exert their effects on non-target insects and other invertebrates as well. Chemical insecticides often persist in the environment and can be slow to degrade, thus potentially accumulating in the food chain. Furthermore the use of persistent chemical insecticides can result in the development of resistance in the target insect species. Thus there has been a long felt need for more environmentally friendly methods for controlling or eradicating insect infestation on or in plants, e. g., methods which are species-selective, environmentally inert, non-persistent, and biodegradable, and that fit well into pest resistance management schemes.

RNA interference (RNAi, RNA-mediated gene suppression) is an approach that shows promise for use in environmentally friendly pest control. In invertebrates, RNAi-based gene suppression was first demonstrated in nematodes (Fire et al., (1998) *Nature,* 391:806-811; Timmons & Fire (1998) *Nature,* 395:854). Subsequently, RNAi-based suppression of invertebrate genes using recombinant nucleic acid techniques has been reported in a number of species, including agriculturally or economically important pests from various insect and nematode taxa, such as: root-knot nematodes (*Meloidogyne* spp.), see Huang et al. (2006) *Proc. Natl. Acad. Sci. USA,* 103:14302-14306, doi:10.1073/pnas.0604698103); cotton bollworm (*Helicoverpa armigera*), see Mao et al. (2007) *Nature Biotechnol.,* 25:1307-1313, doi:10.1038/nbt1352; Western corn rootworm (*Diabrotica virgifera* LeConte), see Baum et al. (2007) *Nature Biotechnol.,* 25:1322-1326, doi:10.1038/nbt1359; sugar beet cyst nematode (*Heterodera schachtii*), see Sindhu et al. (2008) *J. Exp. Botany,* 60:315-324, doi:10.1093/jxb/ern289; mosquito (*Aedes aegypti*), see Pridgeon et al. (2008) *J. Med. Entomol.,* 45:414-420, doi: full/10.1603/0022-2585%282008%2945%5B414%3ATAADRK %5D2.0.CO %3B2; fruit flies (*Drosophila melanogaster*), flour beetles (*Tribolium castaneum*), pea aphids (*Acyrthosiphon pisum*), and tobacco hornworms (*Manduca sexta*), see Whyard et al. (2009) *Insect Biochem. Mol. Biol.,* 39:824-832, doi:10.1016/j.ibmb.2009.09.00; diamondback moth (*Plutella xylostella*), see Gong et al. (2011) *Pest Manag. Sci.,* 67: 514-520, doi:10.1002/ps.2086; green peach aphid (*Myzus persicae*), see Pitino et al. (2011) *PLoS ONE,* 6:e25709, doi:10.1371/journal.pone.0025709; brown planthopper (*Nilaparvata lugens*), see Li et al. (2011) *Pest Manag. Sci.,* 67:852-859, doi:10.1002/ps.2124; and whitefly (*Bemisia tabaci*), see Upadhyay et al. (2011) *J. Biosci.,* 36:153-161, doi:10.1007/s12038-011-9009-1.

SUMMARY

The present embodiments relate to control of insect species, especially flea beetle species that are economically or agriculturally important pests. The compositions and methods disclosed herein include recombinant polynucleotide molecules, such as recombinant DNA constructs for making transgenic plants resistant to infestation by insect species and polynucleotide agents, such as RNA "triggers", that are useful for controlling or preventing infestation by that insect species. Several embodiments described herein relate to a polynucleotide-containing composition (e. g., a composition containing a dsRNA trigger for suppressing a target gene) that is topically applied to an insect species or to a plant, plant part, or seed to be protected from infestation by an insect species. Other embodiments relate to methods for selecting preferred insect target genes that are more likely to be effective targets for RNAi-mediated control of an insect species.

Several embodiments relate to a method for controlling an insect infestation of a plant including contacting the insect with a dsRNA including at least one segment of 18 or more contiguous nucleotides with a sequence of about 95% to about 100% complementarity with a fragment of a target gene of the insect. In some embodiments, the dsRNA includes at least one segment of 21 contiguous nucleotides with a sequence of 100% complementarity with a fragment of a target gene of the insect. In some embodiments, the target gene is selected from the group consisting of Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpS21, RpS4, Rpn2, Rpn3, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments, the target gene has a DNA sequence selected from the group consisting of SEQ ID NOs:1-859. In some embodiments, the dsRNA includes an RNA strand with a sequence of about 95% to about 100% identity or complementarity with a sequence selected from the group consisting of SEQ ID NOs:860-1718 and 1722-1724 or a fragment thereof. In some embodiments, the dsRNA includes an RNA strand with a sequence selected from the group consisting of SEQ ID NOs:860-1718 and 1722-1724. In various embodiments, the contacting of the insect is by oral delivery, or by non-oral contact, e. g., by absorption through the cuticle, or through a combination of oral and non-oral delivery. In some embodiments, the dsRNA trigger suppresses a target gene in the insect and stunts growth, development or reproduction by the insect, or kills the insect.

Several embodiments relate to a method of causing mortality or stunting in an insect, including providing in the diet of an insect at least one polynucleotide including at least one silencing element, wherein the at least one silencing element is essentially identical or essentially complementary to a fragment of a target gene sequence of the insect, and wherein ingestion of the polynucleotide by the insect results in mortality or stunting in the insect. In some embodiments, the target gene is selected from the group consisting of Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpS21, RpS4, Rpn2, Rpn3, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments, the target gene sequence is selected from the group consisting of SEQ ID NOs:1-859. In some embodiments, the silencing element includes an RNA strand with a sequence of about 95% to about 100% identity or complementarity with a sequence selected from the group consisting of SEQ ID NOs:860-1718 and 1722-1724 or a fragment thereof. In some embodiments, the silencing element includes an RNA strand with a sequence selected from the group consisting of SEQ ID NOs:860-1718 and 1722-1724. In some embodiments, the polynucleotide is provided in the diet of the insect in the form of a plant or bacterial cell containing the polynucleotide, or as a synthetic polynucleotide molecule, or as a fermentation product (e. g., a hairpin form of a dsRNA, produced in a bacterium). In some embodiments, the polynucleotide is a recombinant RNA molecule. In some embodiments, the polynucleotide is a double-stranded RNA molecule.

Several embodiments relate to an insecticidal composition including an insecticidally effective amount of a polynucleotide, wherein the polynucleotide includes 18 or more contiguous nucleotides with about 95% to about 100% complementarity with a corresponding portion of a target gene of an insect that infests a plant. In some embodiments, the polynucleotide includes 21 contiguous nucleotides with a sequence of 100% complementarity with a corresponding portion of the target gene. In some embodiments, the target gene is selected from the group consisting of Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpS21, RpS4, Rpn2, Rpn3, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments, the polynucleotide includes 18 or more contiguous nucleotides with about 95% to about 100% complementarity with a DNA sequence selected from the group consisting of SEQ ID NOs:1-859 or a fragment thereof. In some embodiments, the polynucleotide includes 21 contiguous nucleotides with a sequence of 100% complementarity with a DNA sequence selected from the group consisting of SEQ ID NOs:1-859 or a fragment thereof. In some embodiments, the polynucleotide is recombinant RNA. In some embodiments, the polynucleotide is molecule is dsRNA. In some embodiments, the polynucleotide includes at least one segment (e. g., an RNA strand or segment of an RNA strand) with a sequence of about 95% to about 100% identity or complementarity with a sequence selected from the group consisting of SEQ ID NOs:860-1718 and 1722-1724 or a fragment thereof. In some embodiments, polynucleotide includes at least one segment (e. g., an RNA strand or segment of an RNA strand) with a sequence selected from the group consisting of SEQ ID NOs:860-1718 and 1722-1724 or a fragment thereof. In some embodiments, the insecticidal composition further includes one or more of a carrier agent, a surfactant, an organosilicone, a cationic lipid, a polynucleotide herbicidal molecule, a non-polynucleotide herbicidal molecule, a non-polynucleotide pesticide, a fungicide, a safener, an insect attractant, and an insect growth regulator. Embodiments of the insecticidal compositions include non-polynucleotide insecticides, e. g., a bacterially produced insecticidal protein.

Several embodiments relate to a method of providing a plant having improved resistance to an insect, including expressing in the plant a recombinant DNA construct, wherein the recombinant DNA construct includes DNA encoding an RNA polynucleotide having a sequence essentially identical or essentially complementary to a fragment of at least one target gene of the insect, and wherein ingestion of the polynucleotide by the insect results in mortality or stunting in the insect. In some embodiments, the target gene is selected from the group consisting of Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpS21, RpS4, Rpn2, Rpn3, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments, the target gene has a DNA sequence selected from the group consisting of SEQ ID NOs:1-859. In some embodiments, the polynucleotide is single-stranded RNA (ssRNA). In other embodiments, the polynucleotide is double-stranded RNA (dsRNA), which may include single-stranded portions, such as a loop in a stem-loop structure. In some embodiments, the polynucleotide is RNA (e. g., an RNA strand or segment of an RNA strand) with a sequence of about 95% to about 100% identity or complementarity with a sequence selected from the group consisting of SEQ ID NOs:860-1718 and 1722-1724 or a fragment thereof. In some embodiments, the polynucleotide is RNA (e. g., an RNA strand or segment of an RNA strand) with a sequence selected from the group consisting of SEQ ID NOs:860-1718 and 1722-1724 or a fragment thereof.

Several embodiments relate to a recombinant DNA construct including a heterologous promoter operably linked to DNA encoding an RNA transcript including a sequence of about 95% to about 100% identity or complementarity with a sequence selected from the group consisting of SEQ ID NOs:860-1718 and 1722-1724 or a fragment thereof. Several embodiments relate to a commercial unit of seed, such as a bag, in which all or substantially all of the seeds include a recombinant DNA construct including a heterologous promoter operably linked to DNA encoding an RNA transcript including a sequence of about 95% to about 100% identity or complementarity with a sequence selected from the group consisting of SEQ ID NOs:860-1718 and 1722-1724 or a fragment thereof. In some embodiments, the RNA transcript is single-stranded RNA (ssRNA). In other embodiments, the RNA transcript is double-stranded RNA (dsRNA), which may include single-stranded portions, such as a loop in a stem-loop structure. In some embodiments, the RNA transcript includes RNA (e. g., an RNA strand or segment of an RNA strand) with a sequence of about 95% to about 100% identity or complementarity with a sequence selected from the group consisting of SEQ ID NOs:860-1718 and 1722-1724 or a fragment thereof. In some embodiments, the RNA transcript includes RNA (e. g., an RNA strand or segment of an RNA strand) with a sequence selected from the group consisting of SEQ ID NOs:860-1718 and 1722-1724 or a fragment thereof.

In related aspects, provided herein are man-made compositions including a polynucleotide or trigger as described herein, such as dsRNA formulations useful for topical application to a plant or substance in need of protection from an insect infestation; recombinant constructs and vectors useful for making transgenic plant cells and transgenic plants; formulations and coatings useful for treating plants (including plant seeds or propagatable parts such as tubers); plant seeds or propagatable parts such as tubers treated with or containing a polynucleotide as described herein as well as commodity products and foodstuffs produced from such plants; seeds, or propagatable parts (especially commodity products and foodstuffs having a detectable amount of a polynucleotide disclosed herein). Several embodiments relate to polyclonal or monoclonal antibodies that bind a peptide or protein encoded by a sequence or a fragment of a sequence selected from the group consisting of SEQ ID NOs:1-859. Several embodiments relate to polyclonal or monoclonal antibodies that bind a peptide or protein encoded by a sequence or a fragment of a sequence selected from the group consisting of SEQ ID NOs:860-1718 and 1722-1724 or the complement thereof. Such antibodies are made by routine methods as known to one of ordinary skill in the art.

Other aspects and specific embodiments are disclosed in the following detailed description and working Examples.

DETAILED DESCRIPTION

The present embodiments relate to methods and compositions for controlling insect pests, in particular the group of coleopteran insects commonly known as "flea beetles", of which there are several genera. Disclosed herein are target genes identified as useful for designing polynucleotide agents for preventing or treating flea beetle infestations, especially of commercially important plants. The methods and compositions are especially useful for preventing or treating flea beetle infestations of commercially important *Brassica* species including species commercially used as oilseed, food, or livestock feed (e. g., canola, rapeseed, turnips, and field mustard or turnip rape). Such *Brassica* species include *B. napus, B. juncea, B. carinata, B. rapa, B. oleracea, B. rupestris, B. septiceps, B. nigra, B. narinosa, B. perviridus, B. tournefortii,* and *B. fructiculosa*. Also disclosed are sequences for suppressing one or more flea beetle target genes. Several embodiments relate to polynucleotide agents, for example, in the form of dsRNA "triggers" that suppress flea beetle target genes. In some embodiments, polynucleotides and recombinant DNA molecules and constructs useful in methods of controlling insect pests, especially flea beetles are provided. Several embodiments relate to insecticidal compositions, as well as to transgenic plants resistant to infestation by insect pests. Several embodiments relate to methods of identifying efficacious polynucleotide agents, for example, double-stranded RNA molecules for controlling insect pests and methods for identifying target genes that are likely to represent essential functions, making these genes preferred targets for RNAi-mediated silencing and control of insect pests.

Several embodiments relate to methods and compositions for inhibiting or controlling flea beetle infestation of a plant by inhibiting in the flea beetle the expression of one or more target gene selected from the group consisting of Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpS21, RpS4, Rpn2, Rpn3, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments, inhibiting the expression of one or more target gene in the flea beetle results in stunting or mortality.

Several embodiments relate to a polynucleotide molecule, such as a dsRNA, which includes one or more segments including 18 or more contiguous nucleotides, for example 21 or more contiguous nucleotides, having 95% to about 100% (e. g., about 95%, about 96%, about 97%, about 98%, about 99%, or about 100%) complementarity with a fragment of an insect target gene selected from the group consisting of Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpS21, RpS4, Rpn2, Rpn3, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments, the polynucleotide, such as dsRNA, includes multiple segments each of 18 or more contiguous nucleotides with a sequence of about 95% to about 100% (e. g., about 95%, about 96%, about 97%, about 98%, about 99%, or about 100%) complementarity with a fragment of a DNA sequence selected from the group consisting of SEQ ID NOs:1-859. In some embodiments, the polynucleotide, such as dsRNA, includes 21 contiguous nucleotides having 100% complementarity with a fragment of a DNA sequence selected from the group consisting of SEQ ID NOs:1-859. For example, the polynucleotide, such as dsRNA, includes segments corresponding to different regions of the target gene, or can include multiple copies of a segment. In other embodiments, the polynucleotide, such as dsRNA, includes multiple segments, each of 18 or more contiguous nucleotides with a sequence of about 95% to about 100% (e. g., about 95%, about 96%, about 97%, about 98%, about 99%, or about 100%) complementarity with a fragment of a different target gene; in this way multiple target genes, or multiple insect species, can be suppressed.

Several embodiments relate to a dsRNA molecule, sometimes referred to herein as a "trigger", which inhibits the expression of one or more insect target genes selected from the group consisting of Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpS21, RpS4, Rpn2, Rpn3, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VAT-Pase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. Several embodiments relate to a dsRNA having a length greater than that which is typical of naturally occurring regulatory small RNAs (such as endogenously produced siRNAs and mature miRNAs), e. g, the dsRNA is at least about 30 contiguous base-pairs in length. In some embodiments, the dsRNA has a length of between about 50 to about 500 base-pairs. In some embodiments, the dsRNA is at least 50 base pairs in length. In some embodiments, the dsRNA is formed from two separate, essentially complementary strands (e. g., where each strand is separately provided, or where each strand is encoded on a separate DNA molecule, or where the two strands are encoded on separate sections of a DNA and are separately transcribed or made separate, for example, by the action of a recombinase or nuclease), wherein at least one RNA strand includes a sequence of about 95% to about 100% (e. g., about 95%, about 96%, about 97%, about 98%, about 99%, or about 100%) identity or complementarity with a sequence selected from the group consisting of SEQ ID NOs:860-1718 and 1722-1724 or a fragment thereof. In some embodiments, the dsRNA is blunt-ended, e. g., two separate, equal-length strands of RNA which form the dsRNA through intermolecular hybridisation. In some embodiments, the dsRNA has an overhang at one or both ends (termini), e. g., two separate, unequal-length strands of RNA which form the dsRNA through intermolecular hybridisation; the overhang can be a single nucleotide or 2, 3, 4, 5, 6, or more nucleotides, and can be located on the 5' end or on the 3' end of a strand. In some embodiments, the dsRNA includes at least one stem-loop, e. g., a single RNA molecule that forms a dsRNA with a "hairpin" secondary structure through intramolecular hybridization. In some embodiments, the dsRNA is formed from a single self-hybridizing hairpin transcript, wherein one "arm" of the hairpin includes a sequence of about 95% to about 100% (e. g., about 95%, about 96%, about 97%, about 98%, about 99%, or about 100%) identity or complementarity with a sequence selected from the group consisting of SEQ ID NOs:860-1718 and 1722-1724 or a fragment thereof. In embodiments, self-hybridizing transcripts which form hairpins (or partial hairpins) include dsRNA molecules that include "spacer" nucleotides or a single-stranded "loop region" between the dsRNA-forming complementary "arms" of sense sequence and anti-sense sequence. In embodiments, such spacers or loops include nucleotides having a sequence unrelated (not complementary or identical to) the target gene corresponding to the double-stranded portion of the hairpin. Examples of spacers or loops include those encoded by SEQ ID NOs:1719-1721. In embodiments, the dsRNA includes multiple stem-loops, with or without spacer nucleotides between each stem-loop. In embodiments, the dsRNA includes a modified stem-loop such as a "stabilized anti-sense" loop or a "stabilized sense" loop; see, e. g., U.S. Pat. Nos. 7,855,323 and 9,006,414, which are incorporated by reference in their entirety herein.

The dsRNA can be chemically synthesized (e. g., by in vitro transcription, such as transcription using a T7 polymerase or other polymerase), or can be produced by expression in a microorganism, by expression in a plant cell, or by microbial fermentation. The dsRNA can be chemically modified, e. g., to improve stability, ease of formulation, or efficacy. In some embodiments, the dsRNA molecule is provided in a microbial or plant cell that expresses dsRNA (such as a hairpin form of a dsRNA trigger), or in a microbial fermentation product.

A variety of methods for designing and producing a variety of forms of dsRNA are known in the art and are useful in the compositions and methods disclosed herein. See, for example, the following patents which are incorporated by reference in their entirety herein: (1) U.S. Pat. No. 8,598,332 to Waterhouse et al., which discloses recombinant DNA constructs including DNA encoding sense RNA and anti-sense RNA sequences in a single transcript that forms an artificial "hairpin" RNA structure with a double-stranded RNA stem by base-pairing between the sense and anti-sense nucleotide sequences; embodiments include hairpins with spacer nucleotides between the sense and anti-sense nucleotide sequences; (2) U.S. Pat. No. 8,158,414 to Rommens et al., which discloses recombinant DNA constructs including convergently oriented first and second promoters, which produce, e. g., an RNA duplex that is formed by annealing of two separate RNA transcripts; and (3) U.S. Pat. Nos. 7,855,323 and 9,006,414 to Huang et al., which disclose recombinant DNA constructs including DNA encoding "stabilized anti-sense" transcripts which form a loop of anti-sense-oriented RNA for suppressing one or more target genes; recombinant DNA constructs can be designed to similarly encode "stabilized sense" transcripts which form a loop of sense-oriented RNA for suppressing one or more target genes.

Embodiments of the compositions including polynucleotides such as the dsRNA triggers described herein further contain one or more additional components or adjuvants, e. g., a carrier agent, an encapsulation agent, an emulsifying agent, a surfactant, an organosilicone, a cationic lipid, a spreading agent, a photoprotective agent, a rainfastness agent, a polynucleotide herbicidal molecule, a non-polynucleotide herbicidal molecule, a non-polynucleotide pesticide, a non-polynucleotide fungicide, a safener, a bait, an insect attractant, an insect pheromone, and an insect growth regulator. In embodiments, these additional components or adjuvants are edible or digestible if ingested by a flea beetle.

In embodiments, the polynucleotides such as dsRNA triggers disclosed herein are used in combination with a non-nucleotide pesticidal agent such as a small-molecule pesticidal agent or a proteinaceous pesticidal agent, either concurrently or sequentially. Examples of non-nucleotide pesticidal agents include patatins, plant lectins, phytoecdysteroids, and bacterial insecticidal proteins (e. g., insecticidal proteins from *Bacillus thuringiensis, Xenorhabdus* sp., *Photorhabdus* sp., *Brevibacillus laterosporus* (previously *Bacillus laterosporus*), *Lysinibacillus sphaericus* (previously *Bacillus sphaericus*), *Chromobacterium* sp., *Chromobacterium subtsugae, Paenibacillus* sp., *Paenibacillus lentimorbus*, and *Paenibacillus popilliae*), a bacterium that produces an insecticidal protein, and an entomicidal bacterial species. In embodiments, the compositions including polynucleotides for flea beetle control such as the dsRNA triggers described herein can further include, or can be used concurrently or sequentially with, conventional pesticides such as Spiromesifen, Spirodiclofen, Spirotetramat, Pyridaben, Tebufenpyrad, Tolfenpyrad, Fenpyroximate, Flufenerim, Pyrimidifen, Fenazaquin, Rotenone, Cyenopyrafen, Hydramethylnon, Acequinocyl, Fluacrypyrim, Aluminium phosphide, Calcium phosphide, Phosphine, Zinc phosphide, Cyanide, Diafenthiuron, Azocyclotin, Cyhexatin, Fenbutatin oxide, Propargite, Tetradifon, Bensultap, Thiocyclam, Thiosultap-sodium, Flonicamid, Etoxazole, Clofentezine, Diflovidazin, Hexythiazox, Chlorfluazuron, Bistrifluron, Diflubenzuron, Flucycloxuron, Flufenoxuron, Hexaflumuron, Lufenuron, Novaluron, Noviflumuron, Teflubenzuron, Triflumuron, Buprofezin, Cyromazine, Hydroprene, Kinoprene, Methoprene, Fenoxycarb, Pyriproxyfen, Pymetrozine, Pyrifluquinazon, Chlorfenapyr, Tralopyril, *B.t.* (*Bacillus thuringiensis*) var. *aizawai, B.t.* var. *israelensis, B.t.* var. *kurstaki, B.t.* var. *sphaericus, B.t.* var. *tenebrionensis, Bacillus thuringiensis* crop proteins including Cry1Ab, Cry1Ac, Cry1Fa, Cry2Ab, mCry3A, Cry3Ab, Cry3Bb, Cry34/35Ab1, Methyl bromide and other alkyl halides, Chloropicrin, Sulfuryl fluoride, Benclothiaz, Chinomethionat, Cryolite, Methylneodecanamide, Benzoximate, Cymiazole, Fluensulfone, Azadirachtin, Bifenazate, Amidoflumet, Dicofol, Plifenate, Cyflumetofen, Pyridalyl, *Beauveria bassiana* GHA, Sulfoxaflor, Spinetoram, Spinosad, Spinosad, Emamectin benzoate, Lepimectin, Milbemectin, Abamectin, Methoxyfenozide, Chromafenozide, Halofenozide, Tebufenozide, Amitraz, Chlorantraniliprole, Cyantraniliprole, Flubendiamide, alpha-endosulfan, Chlordane, Endosulfan, Fipronil, Acetoprole, Ethiprole, Pyrafluprole, Pyriprole, Indoxacarb and Metaflumizone, Acrinathrin, Allethrin, Allethrin-cis-trans, Allethrin-trans, beta-Cyfluthrin, beta-Cypermethrin, Bifenthrin, Bioallethrin, Bioallethrin S-cyclopentenyl, Bioresmethrin, Cycloprothrin, Cyfluthrin, Cyhalothrin, Cypermethrin, Cyphenothrin [(1R)-trans-isomers], Dimefluthrin, Empenthrin [(EZ)-(1R)-isomers], Esfenvalerate, Etofenprox, Fenpropathrin, Fenvalerate, Flucythrinate, Flumethrin, Gamma-cyhalothryn, lambda-Cyhalothrin, Meperfluthrin, Metofluthrin, Permethrin, Phenothrin [(1R)-trans-isomer], Prallethrin, Profluthrin, Protrifenbute, Resmethrin, Silafluofen, tau-Fluvalinate, Tefluthrin, Tetramethrin, Tetramethrin [(1R)-isomers], Tetramethylfluthrin, theta-Cypermethrin, Tralomethrin, Transfluthrin, zeta-Cypermethrin, alpha-Cypermethrin, Deltamethrin, DDT, and Methoxychlor, Thiodicarb, Alanycarb, Aldicarb, Bendiocarb, Benfuracarb, Butoxycarboxim, Carbaryl, Carbofuran, Carbosulfan, Ethiofencarb, Fenobucarb, Formetanate, Furathiocarb, Isoprocarb, Methiocarb, Methomyl, Metolcarb, Oxamyl, Pirimicarb, Propoxur, Thiofanox, Triazamate, Trimethacarb, XMC, Xylylcarb, Chlorpyrifos, Malathion, Acephate, Azamethiphos, Azinphos-ethyl, Azinphos-methyl, Cadusafos, Chlorethoxyfos, Chlorfenvinphos, Chlormephos, Chlorpyrifos-methyl, Coumaphos, Cyanophos, Demeton-S-methyl, Diazinon, Dichlorvos/DDVP, Dicrotophos, Dimethoate, Dimethylvinphos, Disulfoton, EPN, Ethion, Ethoprophos, Famphur, Fenamiphos, Fenitrothion, Fenthion, Fonofos, Fosthiazate, Imicyafos, Isofenphos-methyl, Mecarbam, Methamidophos, Methidathion, Mevinphos, Monocrotophos, Naled, Omethoate, Oxydemeton-methyl, Parathion, Parathion-methyl, Phenthoate, Phorate, Phosalone, Phosmet, Phosphamidon, Phoxim, Pirimiphos-ethyl, Profenofos, Propaphos, Propetamphos, Prothiofos, Pyraclofos, Pyridaphenthion, Quinalphos, Sulfotep, Tebupirimfos, Temephos, Terbufos, Tetrachlorvinphos, Thiometon, Triazophos, Trichlorfon, Vamidothion Imidacloprid, Thiamethoxam, Acetamiprid, Clothianidin, Dinotefuran, Nitenpyram, Nithiozine, Nicotine, Thiacloprid, chlorantraniliprole, and cyantraniliprole. In embodiments, the compositions including polynucleotides for flea beetle control in *Brassica* species including canola further include, or are used concurrently or sequentially with, foliar sprays including one or more pesticides selected from the group consisting of Deltamethrin, Cypermethrin, Lambda-cyhalothrin, Permethrin, Carbaryl, Carbofuran, and Malathion, or seed treatments including one or more pesticides selected from the group consisting of Thiamethoxam, Imidacloprid, and Clothianadin.

In embodiments, the compositions including polynucleotides for flea beetle control such as the dsRNA triggers described herein can further include, or can be used concurrently or sequentially with, conventional fungicides such as bupirimate, dimethirimol, ethirimol, cyprodinil, pyrimethanil, mepanipyrim, fenpiclonil, fludioxonil; phenylamides, benalaxyl, furalaxyl, metalaxyl, R-metalaxyl, ofurace, oxadixyl, benomyl, carbendazim, debacarb, fuberidazole, thiabendazole, chlozolinate, dichlozoline, iprodine, myclozoline, procymidone, vinclozolin, carboxin, fenfuram, flutolanil, mepronil, oxycarboxin, thifluzamide, guazatine, dodine, iminoctadine, azoxystrobin, kresoxim-methyl, metominostrobin, or trifloxystrobin, ferbam, mancozeb, maneb, metiram, propineb, thiram, zineb, ziram, captafol, captan, dichlofluanid, fluoromide, folpet, tolyfluanid, copper hydroxide, copper oxychloride, copper sulfate, cuprous oxide, mancopper, oxine-copper, dinocap, nitrothal-isopropyl, edifenphos, iprobenphos, isoprothiolane, phosdiphen, pyrazopho, toclofos-methyl, acibenzolar-S-methyl, harpin, anilazine, blasticidin-S, chinomethionat, chloroneb, chlorothalonil, cymoxanil, dichione, diclomezine, dicloran, diethofencarb, dimethomorph, dithianon, etridiazole, famoxadone, fenamidone, fentin, fenpyrazamine, ferimzone, fluazinam, flusulfamide, fosetyl-aluminium, hymexazol, kasugamycin, methasulfocarb, pencycuron, phthalide, polyoxins, probenazole, propamocarb, pyroquilon, quinoxyfen, quintozene, sulfur, triazoxide, tricyclazole, validamycin, azaconazole, bitertanol, propiconazole, difenoconazole, diniconazole, cyproconazole, epoxiconazole, fluquinconazole, flusilazole, flutriafol, hexaconazole, imazalil, imibenconazole, ipconazole, tebuconazole, tetraconazole, fenbuconazole, metconazole, myclobutanil, perfurazoate, penconazole, bromuconazole, pyrifenox, prochloraz, triadimefon, triadimenol, triflumizol, triticonazole, triforine, ancymidol, fenarimol or nuarimol, dodemorph, fenpropidin, fenpropimorph, spiroxamine, tridemorph, and fenhexamid. In embodiments, the compositions including polynucleotides for flea beetle control in *Brassica* species including canola further include, or are used concurrently or sequentially with, foliar sprays including one or more fungicides selected from the group consisting of Azoxystrobin, *Bacillus subtilis* strain QST 2808, Boscalid, Fluxopyroxad, Pyraclostrobin, Metconazole, Prothioconazole, Penthiopyrad, Picoxystrobin, and Thiophanate Methyl, or seed treatments including one or more fungicides selected from the group consisting of Azoxystrobin, Metalaxyl, Trifloxystrobin, Pyraclostrobin, Sedaxane, Penflufen, Fludioxonil, and Mefenoxam.

In embodiments, the compositions including polynucleotides for flea beetle control such as the dsRNA triggers described herein can further include, or can be used concurrently or sequentially with, conventional herbicides such as glyphosate, auxin-like herbicides such as dicamba, phosphinothricin, glufosinate, 2,2-dichloropropionic acid (Dalapon), acetolactate synthase inhibitors such as sulfonylurea, imidazolinone, triazolopyrimidine, pyrimidyloxybenzoates, and phthalide, bromoxynil, cyclohexanedione (sethoxydim) and aryloxyphenoxypropionate (haloxyfop), sulfonamide herbicides, triazine herbicides, 5-methyltryptophan, aminoethyl cysteine, pyridazinone herbicides such as norflurazon, cyclopropylisoxazole herbicides such as isoxaflutole, protoporphyrinogen oxidase inhibitors, herbicidea containing an aryloxyalkanoate moiety, phenoxy auxins such as 2,4-D and dichlorprop, pyridyloxy auxins such as fluroxypyr and triclopyr, aryloxyphenoxypropionates (AOPP) acetyl-coenzyme A carboxylase (ACCase) inhibitors such as haloxyfop, quizalofop, and diclofop, and 5-substituted phenoxyacetate protoporphyrinogen oxidase IX inhibitors such as pyraflufen and flumiclorac. In embodiments, the compositions including polynucleotides for flea beetle control in *Brassica* species including canola further include, or are used concurrently or sequentially with, one or more post-emergence herbicides selected from the group consisting of Quizalofop, Sethoxydim, Clethodim, and Clopyralid. In embodiments, the compositions including polynucleotides for flea beetle control in herbicide-resistant *Brassica* species including herbicide-resistant canola further include, or are used concurrently or sequentially with, one or more herbicides selected from the group consisting of Imazamox, Glyphosate, and Glufosinate.

The compositions and methods disclosed are useful for inhibiting or controlling flea beetle infestation of a plant, such as a *Brassica* species. In embodiments, the compositions and methods are used to treat a growing plant, such as a field of *Brassica* plants. Embodiments include compositions including polynucleotides disclosed herein in a composition in the form of a solid, liquid, powder, suspension, emulsion, spray, encapsulation, microbeads, carrier particulates, film, matrix, soil drench, or seed treatment composition. In embodiments, such compositions are applied to a surface of the plant in need of protection from or treatment for flea beetle infestations, or applied directly to the flea beetles, or provided in an ingestible form to the flea beetles. In embodiments, a composition including polynucleotides disclosed herein is applied directly to ungerminated seeds (such as ungerminated *Brassica* species seeds), providing plants germinated from the treated seeds increased resistance to flea beetle infestations; examples of seed treatment methods are disclosed in U.S. patent application Ser. No. 14/143,836, which is incorporated by reference in its entirety herein. An embodiment includes a *Brassica* seed that is treated by directly contacting the seed with a polynucleotide (such as a dsRNA trigger) disclosed herein, followed by germination into a *Brassica* plant that exhibits increased resistance to flea beetle infestations.

Unless defined otherwise, all technical and scientific terms used herein have the same meaning as commonly understood by one of ordinary skill in the art. The terms "to comprise" or "to include" are understood to mean "to include, but not to be limited to". Generally, the nomenclature used and the manufacturing or laboratory procedures described below are well known and commonly employed in the art. Conventional methods are used for these procedures, such as those provided in the art and various general references. Where a term is provided in the singular, the inventors also contemplate aspects described by the plural of that term. Where there are discrepancies in terms and definitions used in references that are incorporated by reference, the terms used in this application shall have the definitions given. Other technical terms used have their ordinary meaning in the art in which they are used, as exemplified by various art-specific dictionaries, for example, "The American Heritage® Science Dictionary" (Editors of the American Heritage Dictionaries, 2011, Houghton Mifflin Harcourt, Boston and New York), the "McGraw-Hill Dictionary of Scientific and Technical Terms" ($6^{th}$ edition, 2002, McGraw-Hill, New York), or the "Oxford Dictionary of Biology" (6th edition, 2008, Oxford University Press, Oxford and New York). The inventors do not intend to be limited to a mechanism or mode of action. Reference thereto is provided for illustrative purposes only.

Unless otherwise stated, nucleic acid sequences in the text of this specification are given, when read from left to right, in the 5' to 3' direction. One of skill in the art would be aware that a given DNA sequence is understood to define a corresponding RNA sequence which is identical to the DNA sequence except for replacement of the thymine (T) nucleotides of the DNA with uracil (U) nucleotides. Thus, providing a specific DNA sequence is understood to define the exact RNA equivalent. A given first polynucleotide sequence, whether DNA or RNA, further defines the sequence of its exact complement (which can be DNA or RNA), i. e., a second polynucleotide that hybridizes perfectly to the first polynucleotide by forming Watson-Crick base-pairs. By "essentially identical" or "essentially complementary" to a target gene or a fragment of a target gene is meant that a polynucleotide strand (or at least one strand of a double-stranded polynucleotide) is designed to hybridize (generally under physiological conditions such as those found in a living plant or animal cell) to a target gene or to a fragment of a target gene or to the transcript of the target gene or the fragment of a target gene; one of skill in the art would understand that such hybridization does not necessarily require 100% sequence identity or complementarity. A first nucleic acid sequence is "operably" connected or "linked" with a second nucleic acid sequence when the first nucleic acid sequence is placed in a functional relationship with the second nucleic acid sequence. For example, a promoter sequence is "operably linked" to DNA if the promoter provides for transcription or expression of the DNA. Generally, operably linked DNA sequences are contiguous.

The term "polynucleotide" commonly refers to a DNA or RNA molecule containing multiple nucleotides and generally refers both to "oligonucleotides" (a polynucleotide molecule of 18-25 nucleotides in length) and longer polynucleotides of 26 or more nucleotides. Polynucleotides also include molecules containing multiple nucleotides including non-canonical nucleotides or chemically modified nucleotides as commonly practiced in the art; see, e. g., chemical modifications disclosed in the technical manual "RNA Interference (RNAi) and DsiRNAs", 2011 (Integrated DNA Technologies Coralville, Iowa). Generally, polynucleotide as described herein, whether DNA or RNA or both, and whether single- or double-stranded, include at least one segment of 18 or more contiguous nucleotides (or, in the case of double-stranded polynucleotides, at least 18 contiguous base-pairs) that are essentially identical or complementary to a fragment of equivalent size of the DNA of a target gene or the target gene's RNA transcript. Throughout this disclosure, "at least 18 contiguous" means "from about 18 to about 10,000, including every whole number point in between". Thus, embodiments include compositions including oligonucleotides having a length of 18-25 nucleotides (18-mers, 19-mers, 20-mers, 21-mers, 22-mers, 23-mers, 24-mers, or 25-mers), or medium-length polynucleotides having a length of 26 or more nucleotides (polynucleotides of 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, or about 300 nucleotides), or long polynucleotides having a length greater than about 300 nucleotides (e. g., polynucleotides of between about 300 to about 400 nucleotides, between about 400 to about 500 nucleotides, between about 500 to about 600 nucleotides, between about 600 to about 700 nucleotides, between about 700 to about 800 nucleotides, between about 800 to about 900 nucleotides, between about 900 to about 1000 nucleotides, between about 300 to about 500 nucleotides, between about 300 to about 600 nucleotides, between about 300 to about 700 nucleotides, between about 300 to about 800 nucleotides, between about 300 to about 900 nucleotides, or about 1000 nucleotides in length, or even greater than about 1000 nucleotides in length, for example up to the entire length of a target gene including coding or non-coding or both coding and non-coding portions of the target gene). Where a polynucleotide is double-stranded, such as the dsRNA triggers described in the working Examples, its length can be similarly described in terms of base pairs. Double-stranded polynucleotides, such as the dsRNA triggers described in the working examples, can further be described in terms of one or more of the single-stranded components.

The polynucleotides described herein can be single-stranded (ss) or double-stranded (ds). "Double-stranded" refers to the base-pairing that occurs between sufficiently complementary, anti-parallel nucleic acid strands to form a double-stranded nucleic acid structure, generally under physiologically relevant conditions. Embodiments include those wherein the polynucleotide is selected from the group consisting of sense single-stranded DNA (ssDNA), sense single-stranded RNA (ssRNA), double-stranded RNA (dsRNA), double-stranded DNA (dsDNA), a double-stranded DNA/RNA hybrid, anti-sense ssDNA, or anti-sense ssRNA; a mixture of polynucleotides of any of these types can be used. In some embodiments, the polynucleotide is double-stranded RNA of a length greater than that which is typical of naturally occurring regulatory small RNAs (such as endogenously produced siRNAs and mature miRNAs). In some embodiments, the polynucleotide is double-stranded RNA of at least about 30 contiguous base-pairs in length. In some embodiments, the polynucleotide is double-stranded RNA with a length of between about 50 to about 500 base-pairs. In some embodiments, the polynucleotide can include components other than standard ribonucleotides, e. g., an embodiment is an RNA that includes terminal deoxyribonucleotides.

Effective polynucleotides of any size can be used, alone or in combination, in the various methods and compositions described herein. In some embodiments, a single polynucleotide trigger is used to make a composition (e. g., a composition for topical application, or a recombinant DNA construct useful for making a transgenic plant). In other embodiments, a mixture or pool of different polynucleotide triggers is used; in such cases the polynucleotide triggers can be for a single target gene or for multiple target genes.

In various embodiments, the polynucleotide described herein includes naturally occurring nucleotides, such as those which occur in DNA and RNA. In certain embodiments, the polynucleotide is a combination of ribonucleotides and deoxyribonucleotides, for example, synthetic polynucleotides consisting mainly of ribonucleotides but with one or more terminal deoxyribonucleotides or one or more terminal dideoxyribonucleotides or synthetic polynucleotides consisting mainly of deoxyribonucleotides but with one or more terminal dideoxyribonucleotides. In certain embodiments, the polynucleotide includes non-canonical nucleotides such as inosine, thiouridine, or pseudouridine. In certain embodiments, the polynucleotide includes chemically modified nucleotides. Examples of chemically modified oligonucleotides or polynucleotides are well known in the art; see, for example, U.S. Patent Publication 2011/0171287, U.S. Patent Publication 2011/0171176, U.S. Patent Publication 2011/0152353, U.S. Patent Publication 2011/0152346, and U.S. Patent Publication 2011/0160082, which are herein incorporated by reference. Illustrative examples include, but are not limited to, the naturally occurring phosphodiester backbone of an oligonucleotide or polynucleotide which can be partially or completely modified with phosphorothioate, phosphorodithioate, or methylphosphonate internucleotide linkage modifications, modified nucleoside bases or modified sugars can be used in oligonucleotide or polynucleotide synthesis, and oligonucleotides or polynucleotides can be labeled with a fluorescent moiety (e. g., fluorescein or rhodamine) or other label (e. g., biotin).

The term "recombinant", as used to refer to a polynucleotide (such as the recombinant RNA molecules or recombinant DNA constructs described herein), means that the polynucleotide is not a naturally occurring molecule, i. e., that human intervention is required for the polynucleotide to exist. A recombinant polynucleotide is produced using recombinant nucleic acid techniques, or by chemical synthesis, and can include combinations of sequences that do not occur in nature (e. g., combinations of a heterologous promoter and a DNA encoding an RNA to be expressed, or an RNA molecule that includes concatenated segments of a target gene that do not in nature occur adjacent to one another). A recombinant polynucleotide can be biologically produced in a cell (such as a bacterial or plant or animal cell), for example, when that cell is transfected or transformed with a vector encoding the recombinant polynucleotide (e. g., a vector encoding a hairpin form of a dsRNA, produced in a bacterium). A recombinant polynucleotide can include sequences of nucleotides designed in silico using appropriate algorithms.

The polynucleotides or triggers disclosed herein are generally designed to suppress or silence one or more genes ("target genes"). The term "gene" refers to any portion of a nucleic acid that provides for expression of a transcript or encodes a transcript, or that is a hereditable nucleic acid sequence. A "gene" can include, but is not limited to, a promoter region, 5' untranslated regions, transcript encoding regions that can include intronic regions, 3' untranslated regions, or combinations of these regions. In embodiments, the target genes can include coding or non-coding sequence or both. In other embodiments, the target gene has a sequence identical to or complementary to a messenger RNA, e. g., in embodiments the target gene is a cDNA.

As used herein, the term "isolated" refers to separating a molecule from other molecules normally associated with it in its native or natural state. The term "isolated" thus may refer to a DNA molecule that has been separated from other DNA molecule(s) which normally are associated with it in its native or natural state. Such a DNA molecule may be present in a recombined state, such as a recombinant DNA molecule. Thus, DNA molecules fused to regulatory or coding sequences with which they are not normally associated, for example as the result of recombinant techniques, are considered isolated, even when integrated as a transgene into the chromosome of a cell or present with other DNA molecules.

By "insecticidally effective" is meant effective in inducing a physiological or behavioural change in an insect (e. g., adult or larval flea beetles) that infests a plant such as, but not limited to, growth stunting, increased mortality, decrease in reproductive capacity or decreased fecundity, decrease in or cessation of feeding behavior or movement, or decrease in or cessation of metamorphosis stage development. In some embodiments, application of an insecticidally effective amount of the polynucleotide, such as a dsRNA molecule, to a plant improves the plant's resistance to infestation by the insect. In some embodiments, application of an insecticidally effective amount of the polynucleotide, such as a dsRNA molecule, to a crop plant improves yield (e. g., increased biomass, increased seed or fruit production, or increased oil, starch, sugar, or protein content) of that crop plant, in comparison to a crop plant not treated with the polynucleotide. While there is no upper limit on the concentrations and dosages of a polynucleotide as described herein that can be useful in the methods and compositions provided herein, lower effective concentrations and dosages will generally be sought for efficiency and economy. Non-limiting embodiments of effective amounts of a polynucleotide include a range from about 10 nanograms per milliliter to about 100 micrograms per milliliter of a polynucleotide in a liquid form sprayed on a plant, or from about 10 milligrams per acre to about 100 grams per acre of polynucleotide applied to a field of plants, or from about 0.001 to about 0.1 microgram per milliliter of polynucleotide in an artificial diet for feeding the insect. Where compositions as described herein are topically applied to a plant, the concentrations can be adjusted in consideration of the volume of spray or treatment applied to plant leaves or other plant part surfaces, such as flower petals, stems, tubers, fruit, anthers, pollen, leaves, roots, or seeds. In one embodiment, a useful treatment for herbaceous plants using 25-mer polynucleotides as described herein is about 1 nanomole (nmol) of polynucleotides per plant, for example, from about 0.05 to 1 nmol polynucleotides per plant. Other embodiments for herbaceous plants include useful ranges of about 0.05 to about 100 nmol, or about 0.1 to about 20 nmol, or about 1 nmol to about 10 nmol of polynucleotides per plant. In certain embodiments, about 40 to about 50 nmol of a single-stranded polynucleotide as described herein are applied. In certain embodiments, about 0.5 nmol to about 2 nmol of a dsRNA as described herein is applied. In certain embodiments, a composition containing about 0.5 to about 2.0 milligrams per milliliter, or about 0.14 milligrams per milliliter of a dsRNA (or a single-stranded 21-mer) as described herein is applied. In certain embodiments, a composition of about 0.5 to about 1.5 milligrams per milliliter of a dsRNA polynucleotide as described herein of about 50 to about 200 or more nucleotides is applied. In certain embodiments, about 1 nmol to about 5 nmol of a dsRNA as described herein is applied to a plant. In certain embodiments, the polynucleotide composition as topically applied to the plant contains at least one polynucleotide as described herein at a concentration of about 0.01 to about 10 milligrams per milliliter, or about 0.05 to about 2 milligrams per milliliter, or about 0.1 to about 2 milligrams per milliliter. Very large plants, trees, or vines can require correspondingly larger amounts of polynucleotides. When using long dsRNA molecules that can be processed into multiple oligonucleotides (e. g., multiple triggers encoded by a single recombinant DNA molecule as disclosed herein, lower concentrations can be used. Non-limiting examples of effective polynucleotide treatment regimes include a treatment of between about 0.1 to about 1 nmol of polynucleotide molecule per plant, or between about 1 nmol to about 10 nmol of polynucleotide molecule per plant, or between about 10 nmol to about 100 nmol of polynucleotide molecule per plant.

Methods of Causing Insect Mortality and of Controlling Insect Infestations

Several embodiments relate to a method of causing mortality or stunting in an insect, including providing in the diet of an insect at least one recombinant RNA including at least one silencing element essentially identical or essentially complementary to a fragment of a target gene sequence of the insect, wherein the target gene sequence is selected from the group consisting of SEQ ID NOs:1-859, and wherein ingestion of the recombinant RNA by the insect results in mortality or stunting in the insect. These methods are useful for controlling insect infestations of a plant, for example for prevention or treatment of a flea beetle infestation of a crop plant, particularly commercially important *Brassica* species.

In embodiments, the at least one silencing element includes an RNA strand including a sequence of about 95% to about 100% identity or complementarity with a sequence selected from the group consisting of SEQ ID NOs:860-1718 and 1722-1724 or a fragment thereof. In embodiments, the at least one silencing element includes an RNA strand including at least one segment of 18 or more contiguous nucleotides with a sequence of 100% complementarity with a fragment of the target gene of the insect, wherein the target gene has a DNA sequence selected from the group consisting of SEQ ID NOs:1-859. In embodiments, the at least one silencing element includes an RNA strand including at least one segment of 18 or more contiguous nucleotides of an RNA sequence selected from the group consisting of SEQ ID NOs:860-1718 and 1722-1724 or a fragment thereof. In embodiments, the at least one silencing element includes an RNA strand including a sequence selected from the group consisting of SEQ ID NOs:860-1718 and 1722-1724 or a fragment thereof. In embodiments the at least one silencing element includes dsRNA including at least one RNA strand including a sequence of about 95% to about 100% identity or complementarity with a sequence selected from the group consisting of SEQ ID NOs:860-1718 and 1722-1724 or a fragment thereof.

In embodiments, the recombinant RNA is provided in a microbial or plant cell that expresses the recombinant RNA, or in a microbial fermentation product, or is chemically synthesized. In embodiments, the at least one silencing element includes dsRNA. In embodiments, the dsRNA is blunt-ended, or has an overhang at at least one terminus, or includes at least one stem-loop. The dsRNA is provided by convenient techniques commonly used. In embodiments, the dsRNA is chemically synthesized, produced by expression in a microorganism, produced by expression in a plant cell, or produced by microbial fermentation. In embodiments, the dsRNA is made from naturally occurring ribonucleotides; in other embodiments the dsRNA is chemically modified.

In embodiments, the method is useful for causing mortality or stunting in insects that are pests of commercially important crop plants, such as an insect pest of a *Brassica* species. In embodiments, the insect is a flea beetle. In embodiments, the insect is a species of a genus selected from the group consisting of the genera *Alfica, Anthobiodes, Aphthona, Aphthonaltica, Aphthonoides, Apteopeda, Argopistes, Argopus, Arrhenocoela, Batophila, Blepharida, Chaetocnema, Clitea, Crepidodera, Derocrepis, Dibolia, Disonycha, Epitrix, Hermipyxis, Hermaeophaga, Hespera, Hippuriphila, Horaia, Hyphasis, Lipromima, Liprus, Longitarsus, Luperomorpha, Lythraria, Manobia, Mantura, Meishania, Minota, Mniophila, Neicrepidodera, Nonarthra, Novofoudrasia, Ochrosis, Oedionychis, Oglobinia, Omeisphaera, Ophrida, Orestia, Paragopus, Pentamesa, Philopona, Phygasia, Phyllotreta, Podagrica, Podagricomela, Podontia, Pseudodera, Psylliodes, Sangariola, Sinaltica, Sphaeroderma, Systena, Trachyaphthona, Xuthea,* and *Zipangia*. In embodiments, the insect is a species selected from the group consisting of *Altica ambiens* (alder flea beetle), *Altica canadensis* (prairie flea beetle), *Altica chalybaea* (grape flea beetle), *Altica prasina* (poplar flea beetle), *Altica rosae* (rose flea beetle), *Altica sylvia* (blueberry flea beetle), *Altica ulmi* (elm flea beetle), *Chaetocnema pulicaria* (corn flea beele), *Chaetocnema conofinis* (sweet potato flea beetle), *Epitrix cucumeris* (potato flea beetle), *Systena blanda* (palestripped fleabeetle), and *Systena frontalis* (redheaded flea beetle). In embodiments, the insect is a species selected from the group consisting of *Phyllotreta armoraciae* (horseradish flea beetle), *Phyllotreta cruciferae* (canola flea beetle), *Phyllotreta pusilla* (western black flea beetle), *Phyllotreta nemorum* (striped turnip flea beetle), *Phyllotreta atra* (turnip flea beetle), *Phyllotreta robusta* (garden flea beetle), *Phyllotreta striolata* (striped flea beetle), *Phyllotreta undulata, Psylliodes chrysocephala,* and *Psylliodes punctulata* (hop flea beetle).

Embodiments of the method include those in which the recombinant RNA is designed to silence a target gene in a genus- or species-specific manner, for example, wherein (a) the insect is a *Phyllotreta* species and the target gene has a DNA sequence selected from the group consisting of SEQ ID NOs:1-551; (b) the insect is *Phyllotreta atra* (turnip flea beetle) and the target gene has a DNA sequence selected from the group consisting of SEQ ID NOs:1-296; (c) the insect is *Phyllotreta cruciferae* (canola flea beetle) and the target gene has a DNA sequence selected from the group consisting of SEQ ID NOs:297-532; (d) the insect is *Phyllotreta striolata* (striped flea beetle) and the target gene has a DNA sequence selected from the group consisting of SEQ ID NOs:533-551; (e) the insect is a *Psylliodes* species and the target gene has a DNA sequence selected from the group consisting of SEQ ID NOs:552-859; or (f) the insect is *Psylliodes chrysocephala* and the target gene has a DNA sequence selected from the group consisting of SEQ ID NOs:552-859. Embodiments of the method also include those wherein (a) the insect is a *Phyllotreta* species and the silencing element includes an RNA strand including a sequence selected from the group consisting of SEQ ID NOs:860-1410 or a fragment thereof; (b) the insect is *Phyllotreta atra* (turnip flea beetle) and the silencing element includes an RNA strand including a sequence selected from the group consisting of SEQ ID NOs:860-1155 or a fragment thereof; (c) the insect is *Phyllotreta cruciferae* (canola flea beetle) the silencing element includes an RNA strand including a sequence selected from the group consisting of SEQ ID NOs:1156-1391 or a fragment thereof; (d) the insect is *Phyllotreta striolata* (striped flea beetle) and the silencing element includes an RNA strand including a sequence selected from the group consisting of SEQ ID NOs:1392-1410 or a fragment thereof; (e) the insect is a *Psylliodes* species and the silencing element includes an RNA strand including a sequence selected from the group consisting of SEQ ID NOs:1411-1718 or a fragment thereof; or (f) the insect is *Psylliodes chrysocephala* and the silencing element includes an RNA strand including a sequence selected from the group consisting of SEQ ID NOs:1411-1718 or a fragment thereof.

Embodiments of the method include those wherein the at least one recombinant RNA is provided in a composition including the at least one recombinant RNA, wherein the composition is applied to a surface of the insect or to a surface of a seed or plant in need of protection from infestation by the insect. Embodiments of such compositions include those where the composition includes a solid, liquid, powder, suspension, emulsion, spray, encapsulation, microbeads, carrier particulates, film, matrix, soil drench, or seed treatment. In many embodiments, the composition is formulated in a form that is ingested by the insect. In embodiments, the composition further includes one or more components selected from the group consisting of a carrier agent, a surfactant, an organosilicone, a polynucleotide herbicidal molecule, a non-polynucleotide herbicidal molecule, a non-polynucleotide pesticide, a fungicide, a safener, a fertilizer, a micronutrient, an insect attractant, and an insect growth regulator. In embodiments, the composition further includes at least one pesticidal agent selected from the group consisting of a patatin, a plant lectin, a phytoecdy steroid, a *Bacillus thuringiensis* insecticidal protein, a *Xenorhabdus* insecticidal protein, a *Photorhabdus* insecticidal protein, a *Bacillus* laterosporous insecticidal protein, a *Bacillus sphaericus* insecticidal protein, a bacterium that produces an insecticidal protein, an entomicidal bacterial species, *Lysinibacillus sphaericus* (*Bacillus sphaericus*), *Brevibacillus laterosporus* (*Bacillus laterosporus*), *Chromobacterium* species, *Chromobacterium subtsugae, Paenibacillus* species, *Paenibacillus lentimorbus,* and *Paenibacillus popilliae*.

Several embodiments relate to a method for controlling an insect infestation of a plant including contacting the plant and/or an insect that infests a plant with a double-stranded RNA (dsRNA), wherein the dsRNA includes at least one segment of 18 or more contiguous nucleotides with a sequence of about 95% to about 100% (e. g., about 95%, about 96%, about 97%, about 98%, about 99%, or about 100%) complementarity with a fragment of a target gene of the insect selected from the group consisting of Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpS21, RpS4, Rpn2, Rpn3, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments, the dsRNA includes at least one segment of 18 or more contiguous nucleotides with a sequence of about 95% to about 100% complementarity with a fragment of a DNA sequence selected from the group consisting of SEQ ID NOs:1-859. In some embodiments, the dsRNA includes at least one segment of 21 contiguous nucleotides with a sequence of 100% complementarity with a fragment of a DNA sequence selected from the group consisting of SEQ ID NOs:1-859. In this context "controlling" includes inducement of a physiological or behavioural change in an insect (adult or larvae or nymphs) such as, but not limited to, growth stunting, increased mortality, decrease in reproductive capacity, decrease in or cessation of feeding behavior or movement, or decrease in or cessation of metamorphosis stage development. In some embodiments, the dsRNA includes a sequence selected from the group consisting of SEQ ID NOs:860-1155 or a fragment thereof, or the complement thereof.

In various embodiments, the insect is a flea beetle, e. g., a species of a genus selected from the group consisting of the genera *Altica, Anthobiodes, Aphthona, Aphthonaltica, Aphthonoides, Apteopeda, Argopistes, Argopus, Arrhenocoela, Batophila, Blepharida, Chaetocnema, Clitea, Crepidodera, Derocrepis, Dibolia, Disonycha, Epitrix, Hermipyxis, Hermaeophaga, Hespera, Hippuriphila, Horaia, Hyphasis, Lipromima, Liprus, Longitarsus, Luperomorpha, Lythraria, Manobia, Mantura, Meishania, Minota, Mniophila, Neicrepidodera, Nonarthra, Novofoudrasia, Ochrosis, Oedionychis, Oglobinia, Omeisphaera, Ophrida, Orestia, Paragopus, Pentamesa, Philopona, Phygasia, Phyllotreta, Podagrica, Podagricomela, Podontia, Pseudodera, Psylliodes, Sangariola, Sinaltica, Sphaeroderma, Systena, Trachyaphthona, Xuthea*, and *Zipangia*. In some embodiments, the insect is selected from the group consisting of *Altica ambiens* (alder flea beetle), *Altica canadensis* (prairie flea beetle), *Altica chalybaea* (grape flea beetle), *Altica prasina* (poplar flea beetle), *Altica rosae* (rose flea beetle), *Altica sylvia* (blueberry flea beetle), *Altica ulmi* (elm flea beetle), *Chaetocnema pulicaria* (corn flea beele), *Chaetocnema conofinis* (sweet potato flea beetle), *Epitrix cucumeris* (potato flea beetle), *Systena blanda* (palestripped fleabeetle), and *Systena frontalis* (redheaded flea beetle). In some embodiments, the insect is selected from the group consisting of *Phyllotreta armoraciae* (horseradish flea beetle), *Phyllotreta cruciferae* (canola flea beetle), *Phyllotreta pusilla* (western black flea beetle), *Phyllotreta nemorum* (striped turnip flea beetle), *Phyllotreta atra* (turnip flea beetle), *Phyllotreta robusta* (garden flea beetle), *Phyllotreta striolata* (striped flea beetle), *Phyllotreta undulata, Psylliodes chrysocephala*, and *Psylliodes punctulata* (hop flea beetle).

The plant can be any plant that is subject to infestation by an insect that can be controlled by the polynucleotides disclosed herein. Plants of particular interest include commercially important plants, including row crop plants, vegetables, and fruits, and other plants of agricultural or decorative use. Examples of suitable plants are provided under the heading "Plants". The method is especially useful for controlling an insect infestation of an ornamental plant or a crop plant. Various embodiments of the method include those wherein the plant is a plant in the family Brassicaceae, including a *Brassica* species selected from the group consisting of *B. napus, B. juncea, B. carinata, B. rapa, B. oleracea, B. rupestris, B. septiceps, B. nigra, B. narinosa, B. perviridus, B. tournefortii*, and *B. fructiculosa*. In other embodiments, the plant is selected from the group consisting of *Glycine max, Linum usitatissimum, Zea mays, Carthamus tinctorius, Helianthus annuus, Nicotiana tabacum, Arabidopsis thaliana, Betholettia excelsa, Ricinus communis, Cocus nucifera, Coriandrum sativum, Gossypium* spp., *Arachis hypogaea, Simmondsia chinensis, Solanum tuberosum, Elaeis guineensis, Olea europaea, Oryza sativa, Cucurbita maxim, Hordeum vulgare*, and *Triticum aestivum*.

Methods include those developed for specific flea beetle pests for a given plant, e. g., wherein the plant is a potato plant and the insect is *Epitrix cucumeris* (potato flea beetle). In some embodiments, specific target genes are identified as targets for RNAi-mediated control in a given insect species. Various embodiments of the method include those wherein (a) the insect is *Phyllotreta atra* (turnip flea beetle) and the target gene has a DNA sequence selected from the group consisting of SEQ ID NOs:1-296; (b) the insect is *Phyllotreta cruciferae* (canola flea beetle) and the target gene has a DNA sequence selected from the group consisting of SEQ ID NOs:297-532; (c) the insect is *Phyllotreta striolata* (striped flea beetle) and the target gene has a DNA sequence selected from the group consisting of SEQ ID NOs:533-551; or (d) the insect is *Psylliodes chrysocephala* and the target gene has a DNA sequence selected from the group consisting of SEQ ID NOs:552-859.

In some embodiments, specific dsRNA "triggers" are developed for specific target genes in a given insect species. Embodiments of the method include those wherein (a) the insect is *Phyllotreta atra* (turnip flea beetle) and the dsRNA includes at least one RNA sequence selected from the group consisting of SEQ ID NOs:860-1155 or a fragment thereof; (b) the insect is *Phyllotreta cruciferae* (canola flea beetle) and the dsRNA includes at least one RNA sequence selected from the group consisting of SEQ ID NOs:1156-1391 or a fragment thereof; (c) the insect is *Phyllotreta striolata* (striped flea beetle) and the dsRNA includes at least one RNA sequence selected from the group consisting of SEQ ID NOs:1392-1410 or a fragment thereof; or (d) the insect is *Psylliodes chrysocephala* and the dsRNA includes at least one RNA sequence selected from the group consisting of SEQ ID NOs:1411-1718 or a fragment thereof.

The method includes contacting an insect, such as a flea beetle, with a double-stranded RNA (dsRNA). Embodiments include contacting via oral delivery to the insect, or non-oral delivery to the insect, or a combination of oral and non-oral delivery to the insect. Embodiments include contacting insects in the adult stage, or in larval stages, or in the egg stage. In some embodiments, contacting results in mortality (death) or stunting (growth stunting or decrease in or cessation of metamorphosis stage development) of the insect, thereby preventing or treating infestation of the plant by the insect. In some embodiments, contacting results in inducement of a physiological or behavioural change in an insect (adult or larvae or nymphs) that results in a decreased ability of the insect to infest or damage a plant, for example, a decrease in reproductive capacity, or a decrease in or cessation of feeding behavior or movement.

In some embodiments of the method, the contacting includes application of a composition including the dsRNA to a surface of the insect or to a surface of the plant infested by the insect. The composition can include or be in the form of a solid, liquid, powder, suspension, emulsion, spray, encapsulation, microbeads, carrier particulates, film, matrix, soil drench, or seed treatment. In some embodiments, the contacting includes providing the dsRNA in a composition that further includes one or more components selected from the group consisting of a carrier agent, a surfactant, an organosilicone, a polynucleotide herbicidal molecule, a non-polynucleotide herbicidal molecule, a non-polynucleotide pesticide, a fungicide, a safener, an insect attractant, and an insect growth regulator. In some embodiments, the contacting includes providing the dsRNA in a composition that further includes at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, a *Bacillus sphaericus* insecticidal protein, a bacterium that produces an insecticidal protein, an entomicidal bacterial species, *Lysinibacillus sphaericus* (*Bacillus sphaericus*), *Brevibacillus laterosporus* (*Bacillus laterosporus*), *Chromobacterium* species, *Chromobacterium subtsugae*, *Paenibacillus* species, *Paenibacillus lentimorbus*, and *Paenibacillus popilliae*.

In some embodiments of the method, the contacting includes providing the dsRNA in a composition that is ingested by the insect, such as in a liquid, emulsion, or powder applied to a plant on which the insect feeds, or in the form of bait. Such compositions can further includes one or more components selected from the group consisting of a carrier agent, a surfactant, an organosilicone, a polynucleotide herbicidal molecule, a non-polynucleotide herbicidal molecule, a non-polynucleotide pesticide, a fungicide, a safener, an insect attractant, and an insect growth regulator. Such compositions can further include at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, a *Bacillus sphaericus* insecticidal protein, a bacterium that produces an insecticidal protein, an entomicidal bacterial species, *Lysinibacillus sphaericus* (*Bacillus sphaericus*), *Brevibacillus laterosporus* (*Bacillus laterosporus*), *Chromobacterium* species, *Chromobacterium subtsugae*, *Paenibacillus* species, *Paenibacillus lentimorbus*, and *Paenibacillus popilliae*. In embodiments, the combination of the dsRNA and the pesticidal agent provides a level of insect control that is greater than the sum of the effects of the dsRNA and the pesticidal agent components if tested separately.

Insecticidal Compositions

Several embodiments relate to an insecticidal composition including an insecticidally effective amount of a polynucleotide, such as a dsRNA molecule, wherein the polynucleotide includes at least 18 or more contiguous nucleotides with a sequence of about 95% to about 100% (e. g., about 95%, about 96%, about 97%, about 98%, about 99%, or about 100%) complementarity with a fragment of an insect target gene selected from the group consisting of Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpS21, RpS4, Rpn2, Rpn3, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments the polynucleotide includes at least 18 or more contiguous nucleotides having about 95% to about 100% complementarity with a fragment of a DNA sequence selected from the group consisting of SEQ ID NOs:1-859. In some embodiments the polynucleotide includes 21 contiguous nucleotides having 100% complementarity with a fragment of a DNA sequence selected from the group consisting of SEQ ID NOs:1-859. In embodiments, the polynucleotide includes a sequence selected from the group consisting of SEQ ID NOs:860-1718 and 1722-1724 or a fragment thereof.

In various embodiments of the insecticidal composition, the insect is a flea beetle, e. g., a species of a genus selected from the group consisting of the genera *Altica, Anthobiodes, Aphthona, Aphthonaltica, Aphthonoides, Apteopeda, Argopistes, Argopus, Arrhenocoela, Batophila, Blepharida, Chaetocnema, Clitea, Crepidodera, Derocrepis, Dibolia, Disonycha, Epitrix, Hermipyxis, Hermaeophaga, Hespera, Hippuriphila, Horaia, Hyphasis, Lipromima, Liprus, Longitarsus, Luperomorpha, Lythraria, Manobia, Mantura, Meishania, Minota, Mniophila, Neicrepidodera, Nonarthra, Novofoudrasia, Ochrosis, Oedionychis, Oglobinia, Omeisphaera, Ophrida, Orestia, Paragopus, Pentamesa, Philopona, Phygasia, Phyllotreta, Podagrica, Podagricomela, Podontia, Pseudodera, Psylliodes, Sangariola, Sinaltica, Sphaeroderma, Systena, Trachyaphthona, Xuthea,* and *Zipangia*. In some embodiments, the insect is selected from the group consisting of *Altica ambiens* (alder flea beetle), *Altica canadensis* (prairie flea beetle), *Altica chalybaea* (grape flea beetle), *Altica prasina* (poplar flea beetle), *Altica rosae* (rose flea beetle), *Altica sylvia* (blueberry flea beetle), *Altica ulmi* (elm flea beetle), *Chaetocnema pulicaria* (corn flea beele), *Chaetocnema conofinis* (sweet potato flea beetle), *Epitrix cucumeris* (potato flea beetle), *Systena blanda* (palestripped fleabeetle), and *Systena frontalis* (red-headed flea beetle). In some embodiments, the insect is selected from the group consisting of *Phyllotreta armoraciae* (horseradish flea beetle), *Phyllotreta cruciferae* (canola flea beetle), *Phyllotreta pusilla* (western black flea beetle), *Phyllotreta nemorum* (striped turnip flea beetle), *Phyllotreta atra* (turnip flea beetle), *Phyllotreta robusta* (garden flea beetle), *Phyllotreta striolata* (striped flea beetle), *Phyllotreta undulata, Psylliodes chrysocephala,* and *Psylliodes punctulata* (hop flea beetle).

The insecticidal composition is useful for treating a plant or area in the vicinity of a plant to provide protection or treatment from insects, especially flea beetles. A related aspect is a plant treated with an insecticidal composition as described herein, or a seed of the treated plant, wherein the plant exhibits improved resistance to the insect (e. g., improved resistance to flea beetles). In some embodiments, the plant exhibiting improved resistance to the insect is characterized by improved yield, when compared to a plant not treated with the insecticidal composition. In an embodiment, yield (oilseed biomass or oil content) in canola or oilseed rape plants is improved by application of an insecticidally effective amount of a polynucleotide, such as a dsRNA molecule, targetting one or more genes identified from *Phyllotreta cruciferae* (canola flea beetle); in particular embodiments, the target gene has a DNA sequence selected from the group consisting of SEQ ID NOs:297-532. The plant can be any plant that is subject to infestation by an insect that can be controlled by the insecticidal composition. Plants of particular interest include commercially important plants, including row crop plants, vegetables, and fruits, and other plants of agricultural or decorative use. Examples of suitable plants are provided under the heading "Plants". The method is especially useful for controlling an insect infestation of an ornamental plant or a crop plant. Various embodiments include those wherein the plant is a plant in the family Brassicaceae, including a *Brassica* species selected from the group consisting of *B. napus, B. juncea, B. carinata, B. rapa, B. oleracea, B. rupestris, B. septiceps, B. nigra, B. narinosa, B. perviridis, B. tournefortii,* and *B. fructiculosa*. In other embodiments, the plant is selected from the group consisting of *Glycine max, Linum usitatissimum, Zea mays, Carthamus tinctorius, Helianthus annuus, Nicotiana tabacum, Arabidopsis thaliana, Betholettia excelsa, Ricinus communis, Cocus nucifera, Coriandrum sativum, Gossypium* spp., *Arachis hypogaea, Simmondsia chinensis, Solanum tuberosum, Elaeis guineensis, Olea europaea, Oryza sativa, Cucurbita maxim, Hordeum vulgare*, and *Triticum aestivum*.

In some embodiments, the insecticidal composition is developed for specific flea beetle pests for a given plant, e. g., where the plant is a potato plant and the insect is *Epitrix cucumeris* (potato flea beetle). In some embodiments, the insecticidal composition is developed for specific target genes in a given insect species. Specific embodiments of the insecticidal composition include those wherein (a) the insect is *Phyllotreta atra* (turnip flea beetle) and the target gene has a DNA sequence selected from the group consisting of SEQ ID NOs:1-296; (b) the insect is *Phyllotreta cruciferae* (canola flea beetle) and the target gene has a DNA sequence selected from the group consisting of SEQ ID NOs:297-532; (c) the insect is *Phyllotreta striolata* (striped flea beetle) and the target gene has a DNA sequence selected from the group consisting of SEQ ID NOs:533-551; or (d) the insect is *Psylliodes chrysocephala* and the target gene has a DNA sequence selected from the group consisting of SEQ ID NOs:552-859.

In some embodiments the dsRNA molecule of use in this method is provided as an isolated dsRNA molecule (not part of an expression construct, e. g., lacking additional elements such as a promoter or terminator sequences). Such dsRNA molecules can be relatively short, such as single- or double-stranded RNA molecules of between about 18 to about 300 or between about 50 to about 500 nucleotides (for single-stranded polynucleotides) or between about 18 to about 300 or between about 50 to about 500 base-pairs (for double-stranded polynucleotides). In embodiments the polynucleotide is a dsRNA including a segment including a sequence selected from the group consisting of SEQ ID NOs:860-1718 and 1722-1724 or a fragment thereof.

In some embodiments, the insecticidal composition is in a form selected from the group consisting of a solid, liquid, powder, suspension, emulsion, spray, encapsulation, microbeads, carrier particulates, film, matrix, soil drench, insect diet or insect bait, and seed treatment. In some embodiments, the insecticidal composition is provided in a form that is ingested by the insect, such as in a liquid, emulsion, or powder applied to a plant on which the insect feeds, or in the form of bait. The insecticidal compositions can further include one or more components selected from the group consisting of a carrier agent, a surfactant, an organosilicone, a polynucleotide herbicidal molecule, a non-polynucleotide herbicidal molecule, a non-polynucleotide pesticide, a fungicide, a safener, an insect attractant, and an insect growth regulator. The insecticidal compositions can further include at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, a *Bacillus sphaericus* insecticidal protein, a bacterium that produces an insecticidal protein, an entomicidal bacterial species, *Lysinibacillus sphaericus* (*Bacillus sphaericus*), *Brevibacillus laterosporus* (*Bacillus laterosporus*), *Chromobacterium* species, *Chromobacterium subtsugae, Paenibacillus* species, *Paenibacillus lentimorbus*, and *Paenibacillus popilliae*. In some embodiments, the combination of the recombinant RNA molecule and the pesticidal agent provides a level of insect control that is greater than the sum of the effects of the recombinant RNA molecule and the pesticidal agent components if tested separately.

Embodiments of the compositions optionally include the appropriate stickers and wetters required for efficient foliar coverage as well as UV protectants to protect polynucleotides such as dsRNAs from UV damage. Such additives are commonly used in the bioinsecticide industry and are known to those skilled in the art. Compositions for soil application can include granular formulations that serve as bait for insect larvae. Embodiments include a carrier agent, a surfactant, an organosilicone, a polynucleotide herbicidal molecule, a non-polynucleotide herbicidal molecule, a non-polynucleotide pesticide, a fungicide, a safener, an insect attractant, and an insect growth regulator.

Embodiments of compositions may include a "transfer agent", an agent that, when combined with a composition including a polynucleotide as disclosed herein that is topically applied to the surface of an organism, enables the polynucleotide to enter the cells of that organism. Such transfer agents can be incorporated as part of the composition including a polynucleotide as disclosed herein, or can be applied prior to, contemporaneously with, or following application of the composition including a polynucleotide as described herein. In some embodiments, a transfer agent is an agent that improves the uptake of a polynucleotide by an insect. In some embodiments, a transfer agent is an agent that conditions the surface of plant tissue, e. g., seeds, leaves, stems, roots, flowers, or fruits, to permeation by a polynucleotide into plant cells. In some embodiments, the transfer agent enables a pathway for a polynucleotide through cuticle wax barriers, stomata, and/or cell wall or membrane barriers into plant cells.

Suitable transfer agents include agents that increase permeability of the exterior of the organism or that increase permeability of cells of the organism to polynucleotides. Suitable transfer agents include a chemical agent, or a physical agent, or combinations thereof. Chemical agents for conditioning or transfer include (a) surfactants, (b) an organic solvent or an aqueous solution or aqueous mixtures of organic solvents, (c) oxidizing agents, (d) acids, (e) bases, (f) oils, (g) enzymes, or combinations thereof. In some embodiments, application of a polynucleotide and a transfer agent optionally includes an incubation step, a neutralization step (e. g., to neutralize an acid, base, or oxidizing agent, or to inactivate an enzyme), a rinsing step, or combinations thereof. Suitable transfer agents can be in the form of an emulsion, a reverse emulsion, a liposome, or other micellar-like composition, or can cause the polynucleotide composition to take the form of an emulsion, a reverse emulsion, a liposome, or other micellar-like composition. Embodiments of transfer agents include counter-ions or other molecules that are known to associate with nucleic acid molecules, e. g., cationic lipids, inorganic ammonium ions, alkyl ammonium ions, lithium ions, polyamines such as spermine, spermidine, or putrescine, and other cations. Embodiments of transfer agents include organic solvents such as DMSO, DMF, pyridine, N-pyrrolidine, hexamethylphosphoramide, acetonitrile, dioxane, polypropylene glycol, or other solvents miscible with water or that dissolve phosphonucleotides in non-aqueous systems (such as is used in synthetic reactions). Embodiments of transfer agents include naturally derived or synthetic oils with or without surfactants or emulsifiers, e. g., plant-sourced oils, crop oils (such as those listed in the 9$^{th}$ Compendium of Herbicide Adjuvants, publicly available on-line at herbicide.adjuvants.com), paraffinic oils, polyol fatty acid esters, or oils with short-chain molecules modified with amides or polyamines such as polyethyleneimine or N-pyrrolidine.

Embodiments of transfer agents include organosilicone preparations. For example, a suitable transfer agent is an organosilicone preparation that is commercially available as SILWET L-77® brand surfactant having CAS Number 27306-78-1 and EPA Number: CAL.REG.NO. 5905-50073-AA, and currently available from Momentive Performance Materials, Albany, N.Y. In embodiments where a SILWET L-77® brand surfactant organosilicone preparation is used as transfer agent in the form of a spray treatment (applied prior to, contemporaneously with, or following application of the composition including a polynucleotide as disclosed herein) of plant leaves or other plant surfaces, freshly made concentrations in the range of about 0.015 to about 2 percent by weight (wt percent) (e. g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) are efficacious in preparing a leaf or other plant surface for transfer of a polynucleotide as disclosed herein into plant cells from a topical application on the surface. One embodiment includes a composition that includes a polynucleotide and a transfer agent including an organosilicone preparation such as Silwet L-77 in the range of about 0.015 to about 2 percent by weight (wt percent) (e. g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent). One embodiment includes a composition that includes a polynucleotide and a transfer agent including SILWET L-77® brand surfactant in the range of about 0.3 to about 1 percent by weight (wt percent) or about 0.5 to about 1%, by weight (wt percent).

Organosilicone compounds useful as transfer agents for use in compositions and methods disclosed herein include, but are not limited to, compounds that include: (a) a trisiloxane head group that is covalently linked to, (b) an alkyl linker including, but not limited to, an n-propyl linker, that is covalently linked to, (c) a polyglycol chain, that is covalently linked to, (d) a terminal group. Trisiloxane head groups of such organosilicone compounds include, but are not limited to, heptamethyltrisiloxane. Alkyl linkers can include, but are not limited to, an n-propyl linker. Polyglycol chains include, but are not limited to, polyethylene glycol or polypropylene glycol. Polyglycol chains can include a mixture that provides an average chain length "n" of about "7.5". In certain embodiments, the average chain length "n" can vary from about 5 to about 14. Terminal groups can include, but are not limited to, alkyl groups such as a methyl group. Organosilicone compounds useful as transfer agents for use in compositions and methods disclosed herein include, but are not limited to, trisiloxane ethoxylate surfactants or polyalkylene oxide modified heptamethyl trisiloxane. An example of a transfer agent for use in compositions and methods disclosed herein is Compound I:

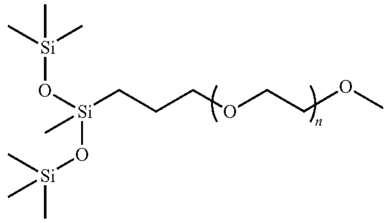

(Compound I: polyalkyleneoxide heptamethyltrisiloxane, average n = 7.5).

Organosilicone compounds useful as transfer agents for use in compositions and methods disclosed herein are used, e. g., as freshly made concentrations in the range of about 0.015 to about 2 percent by weight (wt percent) (e. g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent).

Embodiments of transfer agents include one or more salts such as ammonium chloride, tetrabutylphosphonium bromide, and ammonium sulfate, provided in or used with a composition including a polynucleotide disclosed herein. In some embodiments, ammonium chloride, tetrabutylphosphonium bromide, and/or ammonium sulfate are used at a concentration of about 0.5% to about 5% (w/v), or about 1% to about 3% (w/v), or about 2% (w/v). In certain embodiments, the composition including a polynucleotide includes an ammonium salt at a concentration greater or equal to 300 millimolar. In certain embodiments, the composition including a polynucleotide includes an organosilicone transfer agent in a concentration of about 0.015 to about 2 percent by weight (wt percent) as well as ammonium sulfate at concentrations from about 80 to about 1200 millimolar or about 150 millimolar to about 600 millimolar.

Embodiments of transfer agents include a phosphate salt. Phosphate salts useful in a composition including a polynucleotide include, but are not limited to, calcium, magnesium, potassium, or sodium phosphate salts. In certain embodiments, the composition including a polynucleotide includes a phosphate salt at a concentration of at least about 5 millimolar, at least about 10 millimolar, or at least about 20 millimolar. In certain embodiments, the composition including a polynucleotide includes a phosphate salt in a range of about 1 millimolar to about 25 millimolar or in a range of about 5 millimolar to about 25 millimolar. In certain embodiments, the composition including a polynucleotide includes sodium phosphate at a concentration of at least about 5 millimolar, at least about 10 millimolar, or at least about 20 millimolar. In certain embodiments, the composition including a polynucleotide includes sodium phosphate at a concentration of about 5 millimolar, about 10 millimolar, or about 20 millimolar. In certain embodiments, the composition including a polynucleotide includes a sodium phosphate salt in a range of about 1 millimolar to about 25 millimolar or in a range of about 5 millimolar to about 25 millimolar. In certain embodiments, the composition including a polynucleotide includes a sodium phosphate salt in a range of about 10 millimolar to about 160 millimolar or in a range of about 20 millimolar to about 40 millimolar. In certain embodiments, the composition including a polynucleotide includes a sodium phosphate buffer at a pH of about 6.8.

Embodiments of transfer agents include surfactants and/or effective molecules contained therein. Surfactants and/or effective molecules contained therein include, but are not limited to, sodium or lithium salts of fatty acids (such as tallow or tallowamines or phospholipids) and organosilicone surfactants. In certain embodiments, the composition including a polynucleotide is formulated with counter-ions or other molecules that are known to associate with nucleic acid molecules. Non-limiting examples include, tetraalkyl ammonium ions, trialkyl ammonium ions, sulfonium ions, lithium ions, and polyamines such as spermine, spermidine, or putrescine. In certain embodiments, the composition including a polynucleotide is formulated with a non-polynucleotide herbicide e. g., glyphosate, auxin-like benzoic acid herbicides including dicamba, chloramben, and TBA, glufosinate, auxin-like herbicides including phenoxy carboxylic acid herbicide, pyridine carboxylic acid herbicide, quinoline carboxylic acid herbicide, pyrimidine carboxylic acid herbicide, and benazolin-ethyl herbicide, sulfonylureas, imidazolinones, bromoxynil, delapon, cyclohezanedione, protoporphyrinogen oxidase inhibitors, and 4-hydroxyphenyl-pyruvate-dioxygenase inhibiting herbicides. In certain embodiments, the composition including a polynucleotide is formulated with a non-polynucleotide pesticide, e. g., a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein.

Methods of Providing Plants with Improved Insect Resistance

Several embodiments relate to a method of providing a plant having improved resistance to an insect, including expressing in the plant a recombinant DNA construct, wherein the recombinant DNA construct includes DNA encoding an RNA having a sequence essentially identical or essentially complementary to a fragment of at least one insect target gene selected from the group consisting of Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpS21, RpS4, Rpn2, Rpn3, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments, the DNA construct includes DNA encoding an RNA including a sequence essentially identical or essentially complementary to a fragment of a DNA sequence selected from the group consisting of SEQ ID NOs:1-859. Several embodiments relate to a plant produced by such method. In some embodiments, the DNA construct includes DNA encoding an RNA having about 95% to about 100% (e. g., about 95%, about 96%, about 97%, about 98%, about 99%, or about 100%) identity or complementarity with a sequence selected from the group consisting of SEQ ID NOs:860-1718 and 1722-1724 or a fragment thereof.

In some embodiments, the recombinant DNA construct further includes a heterologous promoter operably linked to the DNA encoding an RNA, wherein the heterologous promoter is functional in a plant cell. "Heterologous" refers to nucleic acid sequences that are not usually operably linked in a native or naturally occurring genome; by "heterologous promoter" is meant that the promoter is not natively operably linked with the DNA encoding an RNA. Promoters functional in a plant cell include those listed under the heading "Promoters".

In some embodiments, the recombinant DNA construct is expressed in the plant by means of transgenic expression or transient expression. In some embodiments, the method further includes expression in the plant of at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, a *Bacillus sphaericus* insecticidal protein, a bacterium that produces an insecticidal protein, an entomicidal bacterial species, *Lysinibacillus sphaericus* (*Bacillus sphaericus*), *Brevibacillus laterosporus* (*Bacillus laterosporus*), *Chromobacterium* species, *Chromobacterium subtsugae*, *Paenibacillus* species, *Paenibacillus lentimorbus*, and *Paenibacillus popilliae*. The pesticidal agent can be expressed from the same recombinant DNA construct that includes the DNA encoding an RNA, or from a different recombinant DNA construct.

A related aspect is a plant having improved resistance to an insect (e. g., improved resistance to flea beetles), or the seed of such a plant, wherein the plant is provided by the method including expressing in the plant a recombinant DNA construct, wherein the recombinant DNA construct includes DNA encoding an RNA having a sequence essentially identical or essentially complementary to a fragment of at least one target gene of the insect, wherein the target gene is selected from the group consisting of Act5C, arginine kinase, COPI (coatomer subunit) alpha, COPI (coatomer subunit) beta, COPI (coatomer subunit) betaPrime, COPI (coatomer subunit) delta, COPI (coatomer subunit) epsilon, COPI (coatomer subunit) gamma, COPI (coatomer subunit) zeta, RpL07, RpL19, RpL3, RpL40, RpS21, RpS4, Rpn2, Rpn3, Rpt6, Rpn8, Rpn9, Rpn6-PB-like protein, Sar1, sec6, sec23, sec23A, shrb (snf7), Tubulin gamma chain, ProsAlpha2, ProsBeta5, Proteasome alpha 2, Proteasome beta 5, VATPase E, VATPase A, VATPase B, VATPase D, Vps2, Vps4, Vps16A, Vps20, Vps24, Vps27, Vps28, Vha26 (V-ATPase A), Vha68-2 (V-ATPase D/E), 40S ribosomal protein S14, and 60S ribosomal protein L13. In some embodiments, the recombinant DNA construct includes DNA encoding an RNA including a sequence essentially identical or essentially complementary to a fragment of a DNA sequence selected from the group consisting of SEQ ID NOs:1-859. In some embodiments, the plant exhibiting improved resistance to the insect is characterized by improved yield, when compared to a plant not expressing the recombinant DNA construct. In an embodiment, yield (oilseed biomass or oil content) in canola or oilseed rape plants is improved by expressing in the canola or oilseed rape plants a polynucleotide, such as a dsRNA molecule, targetting one or more genes of *Phyllotreta cruciferae* (canola flea beetle), e. g., wherein the target gene has a DNA sequence selected from the group consisting of SEQ ID NOs:297-532. Several embodiments relate to fruit, seed, or propagatable parts of the plant provided by this method and exhibiting improved resistance to the insect. The plant can be any plant that is subject to infestation by an insect that can be controlled by expressing in the plant the recombinant DNA construct according to this method. Plants of particular interest include commercially important plants, including row crop plants, vegetables, and fruits, and other plants of agricultural or decorative use. Examples of suitable plants are provided under the heading "Plants". The method is especially useful for providing an ornamental plant or a crop plant with improved resistance to flea beetles. Various embodiments of the method include those wherein the plant is a plant in the family Brassicaceae, including a *Brassica* species selected from the group consisting of *B. napus, B. juncea, B. carinata, B. rapa, B. oleracea, B. rupestris, B. septiceps, B. nigra, B. narinosa, B. perviridus, B. tournefortii*, and *B. fructiculosa*. In other embodiments, the plant is selected from the group consisting of *Glycine max, Linum usitatissimum, Zea mays, Carthamus tinctorius, Helianthus annuus, Nicotiana tabacum, Arabidopsis thaliana, Bertholletia excelsa, Ricinus communis, Cocus nucifera, Coriandrum sativum, Gossypium* spp., *Arachis hypogaea, Simmondsia chinensis, Solanum tuberosum, Elaeis guineensis, Olea europaea, Oryza sativa, Cucurbita maxim, Hordeum vulgare*, and *Triticum aestivum*. In an embodiment, the method provides a potato plant with improved resistance to *Epitrix cucumeris* (potato flea beetle).

Embodiments of the method provide a plant having improved resistance to one or more flea beetle species, e. g., a species of a genus selected from the group consisting of the genera *Altica, Anthobiodes, Aphthona, Aphthonaltica, Aphthonoides, Apteopeda, Argopistes, Argopus, Arrhenocoela, Batophila, Blepharida, Chaetocnema, Clitea, Crepidodera, Derocrepis, Dibolia, Disonycha, Epitrix, Hermipyxis, Hermaeophaga, Hespera, Hippuriphila, Horaia, Hyphasis, Lipromima, Liprus, Longitarsus, Luperomorpha, Lythraria, Manobia, Mantura, Meishania, Minota, Mniophila, Neicrepidodera, Nonarthra, Novofoudrasia, Ochrosis, Oedionychis, Oglobinia, Omeisphaera, Ophrida, Orestia, Paragopus, Pentamesa, Philopona, Phygasia, Phyllotreta, Podagrica, Podagricomela, Podontia, Pseudodera, Psylliodes, Sangariola, Sinaltica, Sphaeroderma, Systena, Trachyaphthona, Xuthea*, and *Zipangia*. In embodiments, the insect is selected from the group consisting of *Altica ambiens* (alder flea beetle), *Altica canadensis* (prairie flea beetle), *Altica chalybaea* (grape flea beetle), *Altica prasina* (poplar flea beetle), *Altica rosae* (rose flea beetle), *Altica sylvia* (blueberry flea beetle), *Altica ulmi* (elm flea beetle), *Chaetocnema pulicaria* (corn flea beele), *Chaetocnema conofinis* (sweet potato flea beetle), *Epitrix cucumeris* (potato flea beetle), *Systena blanda* (palestripped fleabeetle), and *Systena frontalis* (redheaded flea beetle). In embodiments, the method provides a plant having improved resistance to an insect selected from the group consisting of *Phyllotreta armoraciae* (horseradish flea beetle), *Phyllotreta cruciferae* (canola flea beetle), *Phyllotreta pusilla* (western black flea beetle), *Phyllotreta nemorum* (striped turnip flea beetle), *Phyllotreta atra* (turnip flea beetle), *Phyllotreta robusta* (garden flea beetle), *Phyllotreta striolata* (striped flea beetle), *Phyllotreta undulata, Psylliodes chrysocephala*, and *Psylliodes punctulata* (hop flea beetle).

In some embodiments, the method is developed for specific target genes in a given insect species. In some embodiments, a plant having improved resistance to *Phyllotreta atra* (turnip flea beetle), wherein the target gene has a DNA sequence selected from the group consisting of SEQ ID NOs:1-296, is provided. In some embodiments, a plant having improved resistance to *Phyllotreta cruciferae* (canola flea beetle), wherein the target gene has a DNA sequence selected from the group consisting of SEQ ID NOs:297-532, is provided. In some embodiments, a plant having improved resistance to *Phyllotreta striolata* (striped flea beetle), wherein the target gene has a DNA sequence selected from the group consisting of SEQ ID NOs:533-551, is provided. In some embodiments, a plant having improved resistance to *Psylliodes chrysocephala*, wherein the target gene has a DNA sequence selected from the group consisting of SEQ ID NOs:552-859, is provided. In some embodiments, a plant having improved resistance to *Phyllotreta atra* (turnip flea beetle) that expresses from a recombinant DNA construct a dsRNA strand including a sequence of about 95% to about 100% identity with a sequence selected from the group consisting of SEQ ID NOs:860-1155 or a fragment thereof is provided. In some embodiments, a plant having improved resistance to *Phyllotreta cruciferae* (canola flea beetle) that expresses from a recombinant DNA construct a dsRNA including a strand including a sequence of about 95% to about 100% identity with a sequence selected from the group consisting of SEQ ID NOs:1156-1391 or a fragment thereof is provided. In some embodiments, a plant having improved resistance to *Phyllotreta striolata* (striped flea beetle) that expresses from a recombinant DNA construct a dsRNA including a strand including a sequence of about 95% to about 100% identity with a sequence selected from the group consisting of SEQ ID NOs:1392-1410 or a fragment thereof is provided. In some embodiments, a plant having improved resistance to *Psylliodes chrysocephala* that expresses from a recombinant DNA construct a dsRNA including a strand including a sequence of about 95% to about 100% identity with a sequence selected from the group consisting of SEQ ID NOs:1411-1718 or a fragment thereof is provided.

Recombinant DNA Constructs Encoding RNA for Insect Control

Several embodiments relate to a recombinant DNA construct including a heterologous promoter operably linked to DNA encoding an RNA transcript including a sequence of about 95% to about 100% (e. g., about 95%, about 96%, about 97%, about 98%, about 99%, or about 100%) identity or complementarity with a sequence selected from the group consisting of SEQ ID NOs:860-1718 and 1722-1724 or a fragment thereof.

In some embodiments of the recombinant DNA construct, the RNA transcript includes at least one RNA strand including a sequence of about 95% to about 100% (e. g., about 95%, about 96%, about 97%, about 98%, about 99%, or about 100%) identity or complementarity with a sequence selected from the group consisting of SEQ ID NOs:860-1718 and 1722-1724 or a fragment thereof. In some embodiments, the RNA transcript forms dsRNA. In some embodiments, the RNA transcript is a dsRNA including an RNA strand including at least one segment of 18 or more contiguous nucleotides of an RNA sequence selected from the group consisting of SEQ ID NOs:860-1718 and 1722-1724 or a fragment thereof. In some embodiments, the RNA transcript is a dsRNA including an RNA strand including at least one segment of 21 contiguous nucleotides of an RNA sequence selected from the group consisting of SEQ ID NOs:860-1718 and 1722-1724 or a fragment thereof. In some embodiments, the RNA transcript is a dsRNA including at least one RNA strand including a sequence of about 95% to about 100% identity or complementarity with a sequence selected from the group consisting of SEQ ID NOs:860-1718 and 1722-1724 or a fragment thereof. In some embodiments, the RNA transcript is a dsRNA including an RNA strand including a sequence selected from the group consisting of SEQ ID NOs:860-1718 and 1722-1724 or a fragment thereof.

In some embodiments of the recombinant DNA construct, the heterologous promoter is functional for expression of the RNA transcript in a bacterium. In some embodiments where the recombinant DNA construct is to be expressed in a bacterium, the bacterium is selected from the group consisting of *Escherichia coli, Bacillus species, Pseudomonas* species, *Xenorhabdus* species, or *Photorhabdus* species. In other embodiments, the recombinant DNA construct includes a heterologous promoter that is functional in a plant cell.

In some embodiments, the recombinant DNA construct is contained in a recombinant vector, such as a recombinant plant virus vector or a recombinant baculovirus vector. In embodiments, the recombinant DNA construct is integrated into a plant chromosome or plastid, e. g., by stable transformation.

Related aspects include a transgenic plant cell including in its genome the recombinant DNA construct, and a transgenic plant including such a transgenic plant cell. Transgenic plant cells and plants are made by methods known in the art, such as those described under the heading "Making and Using Transgenic Plant Cells and Transgenic Plants". Further aspects include a commodity product produced from such a transgenic plant, and transgenic progeny seed or propagatable plant part of the transgenic plant.

Related Information and Techniques

Plants

The methods and compositions described herein for treating and protecting plants from insect infestations are useful across a broad range of plants. Suitable plants in which the methods and compositions disclosed herein can be used include, but are not limited to, cereals and forage grasses (rice, maize, wheat, barley, oat, sorghum, pearl millet, finger millet, cool-season forage grasses, and bahiagrass), oilseed crops (soybean, oilseed brassicas including canola and oilseed rape, sunflower, peanut, flax, sesame, and safflower), legume grains and forages (common bean, cowpea, pea, fava bean, lentil, tepary bean, Asiatic beans, pigeonpea, vetch, chickpea, lupine, alfalfa, and clovers), temperate fruits and nuts (apple, pear, peach, plums, berry crops, cherries, grapes, olive, almond, and Persian walnut), tropical and subtropical fruits and nuts (citrus including limes, oranges, and grapefruit; banana and plantain, pineapple, papaya, mango, avocado, kiwifruit, passionfruit, and persimmon), vegetable crops (solanaceous plants including tomato, eggplant, and peppers; vegetable brassicas; radish, carrot, cucurbits, alliums, asparagus, and leafy vegetables), sugar, tuber, and fiber crops (sugarcane, sugar beet, stevia, potato, sweet potato, cassava, and cotton), plantation crops, ornamentals, and turf grasses (tobacco, coffee, cocoa, tea, rubber tree, medicinal plants, ornamentals, and turf grasses), and forest tree species. Specific plant species of interest are plants in the family Brassicaceae, including the *Brassica* species *B. napus, B. juncea, B. carinata, B. rapa, B. oleracea, B. rupestris, B. septiceps, B. nigra, B. narinosa, B. perviridus, B. tournefortii*, and *B. fructiculosa*. Additional plant species of interest are *Glycine max, Linum usitatissimum, Zea mays, Carthamus tinctorius, Helianthus annuus, Nicotiana tabacum, Arabidopsis thaliana, Betholettia excelsa, Ricinus communis, Cocos nucifera, Coriandrum sativum, Gossypium* spp., *Arachis hypogaea, Simmondsia chinensis, Solanum tuberosum, Elaeis guineensis, Olea europaea, Oryza sativa, Cucurbita maxim, Hordeum vulgare*, and *Triticum aestivum*.

Additional Construct Elements

Embodiments of the polynucleotides and nucleic acid molecules disclosed herein can include additional elements, such as promoters, small RNA recognition sites, aptamers or ribozymes, additional and additional expression cassettes for expressing coding sequences (e. g., to express a transgene such as an insecticidal protein or selectable marker) or non-coding sequences (e. g., to express additional suppression elements). For example, an aspect provides a recombinant DNA construct including a heterologous promoter operably linked to DNA encoding an RNA transcript including a sequence of about 95% to about 100% identity or complementarity with a sequence selected from the group consisting of SEQ ID NOs:860-1718 and 1722-1724 or a fragment thereof. In another embodiment, a recombinant DNA construct including a promoter operably linked to DNA encoding: (a) an RNA transcript including a sequence of about 95% to about 100% identity or complementarity with a sequence selected from the group consisting of SEQ ID NOs:860-1718 and 1722-1724 or a fragment thereof, and (b) an aptamer, is stably integrated into the plant's genome from where RNA transcripts including the RNA aptamer and the RNA silencing element are expressed in cells of the plant; the aptamer serves to guide the RNA silencing element to a desired location in the cell. In another embodiment, inclusion of one or more recognition sites for binding and cleavage by a small RNA (e. g., by a miRNA or an siRNA that is expressed only in a particular cell or tissue) allows for more precise expression patterns in a plant, wherein the expression of the recombinant DNA construct is suppressed where the small RNA is expressed. Such additional elements are described below.

Promoters

Promoters of use in the compositions and methods disclosed herein are functional in the cell in which the construct is intended to be transcribed. Generally these promoters are heterologous promoters, as used in recombinant constructs, i. e., they are not in nature found to be operably linked to the other nucleic elements used in the constructs. In various embodiments, the promoter is selected from the group consisting of a constitutive promoter, a spatially specific promoter, a temporally specific promoter, a developmentally specific promoter, and an inducible promoter. In many embodiments the promoter is a promoter functional in a plant, for example, a pol II promoter, a pol III promoter, a pol IV promoter, or a pol V promoter.

Non-constitutive promoters suitable for use with the recombinant DNA constructs disclosed herein include spatially specific promoters, temporally specific promoters, and inducible promoters. Spatially specific promoters can include organelle-, cell-, tissue-, or organ-specific promoters (e. g., a plastid-specific, a root-specific, a pollen-specific, or a seed-specific promoter for expression in plastids, roots, pollen, or seeds, respectively). In many cases a seed-specific, embryo-specific, aleurone-specific, or endosperm-specific promoter is especially useful. Temporally specific promoters can include promoters that tend to promote expression during certain developmental stages in a plant's growth cycle, or during different times of day or night, or at different seasons in a year. Inducible promoters include promoters induced by chemicals or by environmental conditions such as, but not limited to, biotic or abiotic stress (e. g., water deficit or drought, heat, cold, high or low nutrient or salt levels, high or low light levels, or pest or pathogen infection). MicroRNA promoters are useful, especially those having a temporally specific, spatially specific, or inducible expression pattern; examples of miRNA promoters, as well as methods for identifying miRNA promoters having specific expression patterns, are provided in U. S. Patent Application Publications 2006/0200878, 2007/0199095, and 2007/0300329, which are specifically incorporated herein by reference. An expression-specific promoter can also include promoters that are generally constitutively expressed but at differing degrees or "strengths" of expression, including promoters commonly regarded as "strong promoters" or as "weak promoters".

Promoters of particular interest include the following examples: an opaline synthase promoter isolated from T-DNA of *Agrobacterium*; a cauliflower mosaic virus 35S promoter; enhanced promoter elements or chimeric promoter elements such as an enhanced cauliflower mosaic virus (CaMV) 35S promoter linked to an enhancer element (an intron from heat shock protein 70 of *Zea mays*); root specific promoters such as those disclosed in U.S. Pat. Nos. 5,837,848; 6,437,217 and 6,426,446; a maize L3 oleosin promoter disclosed in U.S. Pat. No. 6,433,252; a promoter for a plant nuclear gene encoding a plastid-localized aldolase disclosed in U. S. Patent Application Publication 2004/0216189; cold-inducible promoters disclosed in U.S. Pat. No. 6,084,089; salt-inducible promoters disclosed in U.S. Pat. No. 6,140,078; light-inducible promoters disclosed in U.S. Pat. No. 6,294,714; pathogen-inducible promoters disclosed in U.S. Pat. No. 6,252,138; and water deficit-inducible promoters disclosed in U.S. Patent Application Publication 2004/0123347 A1. All of the above-described patents and patent publications disclosing promoters and their use, especially in recombinant DNA constructs functional in plants are incorporated herein by reference.

Plant vascular- or phloem-specific promoters of interest include a rolC or rolA promoter of *Agrobacterium rhizogenes*, a promoter of a *Agrobacterium tumefaciens* T-DNA gene 5, the rice sucrose synthase RSs 1 gene promoter, a *Commelina* yellow mottle badnavirus promoter, a coconut foliar decay virus promoter, a rice tungro bacilliform virus promoter, the promoter of a pea glutamine synthase GS3A gene, a invCD 111 and invCD 141 promoters of a potato invertase genes, a promoter isolated from *Arabidopsis* shown to have phloem-specific expression in tobacco by Kertbundit et al. (1991) *Proc. Natl. Acad Sci. USA.*, 88:5212-5216, a VAHOX1 promoter region, a pea cell wall invertase gene promoter, an acid invertase gene promoter from carrot, a promoter of a sulfate transporter gene Sultr1; 3, a promoter of a plant sucrose synthase gene, and a promoter of a plant sucrose transporter gene.

Promoters suitable for use with a recombinant DNA construct or polynucleotide disclosed herein include polymerase II ("pol II") promoters and polymerase III ("pol III") promoters. RNA polymerase II transcribes structural or catalytic RNAs that are usually shorter than 400 nucleotides in length, and recognizes a simple run of T residues as a termination signal; it has been used to transcribe siRNA duplexes (see, e. g., Lu et al. (2004) *Nucleic Acids Res.,* 32:e171). Pol II promoters are therefore preferred in certain embodiments where a short RNA transcript is to be produced from a recombinant DNA construct. In one embodiment, the recombinant DNA construct includes a pol II promoter to express an RNA transcript flanked by self-cleaving ribozyme sequences (e. g., self-cleaving hammerhead ribozymes), resulting in a processed RNA, such as a single-stranded RNA that binds to the transcript of the flea beetle target gene, with defined 5' and 3' ends, free of potentially interfering flanking sequences. An alternative approach uses pol III promoters to generate transcripts with relatively defined 5' and 3' ends, i. e., to transcribe an RNA with minimal 5' and 3' flanking sequences. In some embodiments, Pol III promoters (e. g., U6 or H1 promoters) are preferred for adding a short AT-rich transcription termination site that results in 2 base-pair overhangs (UU) in the transcribed RNA; this is useful, e. g., for expression of siRNA-type constructs. Use of pol III promoters for driving expression of siRNA constructs has been reported; see van de Wetering et al. (2003) *EMBO Rep.*, 4: 609-615, and Tuschl (2002) *Nature Biotechnol.*, 20: 446-448. Baculovirus promoters such as baculovirus polyhedrin and p10 promoters are known in the art and commercially available; see, e. g., Invitrogen's "Guide to Baculovirus Expression Vector Systems (BEVS) and Insect Cell Culture Techniques", 2002 (Life Technologies, Carlsbad, Calif.) and F. J. Haines et al. "Baculovirus Expression Vectors", undated (Oxford Expression Technologies, Oxford, UK).

The promoter element can include nucleic acid sequences that are not naturally occurring promoters or promoter elements or homologues thereof but that can regulate expression of a gene. Examples of such "gene independent" regulatory sequences include naturally occurring or artificially designed RNA sequences that include a ligand-binding region or aptamer (see "Aptamers", below) and a regulatory region (which can be cis-acting). See, for example, Isaacs et al. (2004) *Nat. Biotechnol.*, 22:841-847, Bayer and Smolke (2005) *Nature Biotechnol.*, 23:337-343, Mandal and Breaker (2004) *Nature Rev. Mol. Cell Biol.*, 5:451-463, Davidson and Ellington (2005) *Trends Biotechnol.*, 23:109-112, Winkler et al. (2002) *Nature,* 419:952-956, Sudarsan et al. (2003) *RNA,* 9:644-647, and Mandal and Breaker (2004) *Nature Struct. Mol. Biol.*, 11:29-35. Such "riboregulators" could be selected or designed for specific spatial or temporal specificity, for example, to regulate translation of DNA that encodes a silencing element for suppressing a target gene only in the presence (or absence) of a given concentration of the appropriate ligand. One example is a riboregulator that is responsive to an endogenous ligand (e. g., jasmonic acid or salicylic acid) produced by the plant when under stress (e. g., abiotic stress such as water, temperature, or nutrient stress, or biotic stress such as attach by pests or pathogens); under stress, the level of endogenous ligand increases to a level sufficient for the riboregulator to begin transcription of the DNA that encodes a silencing element for suppressing a target gene.

Recombinase Sites

In some embodiments, the recombinant DNA construct or polynucleotide includes DNA encoding one or more site-specific recombinase recognition sites. In one embodiment, the recombinant DNA construct includes at least a pair of loxP sites, wherein site-specific recombination of DNA between the loxP sites is mediated by a Cre recombinase. The position and relative orientation of the loxP sites is selected to achieve the desired recombination; for example, when the loxP sites are in the same orientation, the DNA between the loxP sites is excised in circular form. In another embodiment, the recombinant DNA construct includes DNA encoding one loxP site; in the presence of Cre recombinase and another DNA with a loxP site, the two DNAs are recombined.

Aptamers

In some embodiments, the recombinant DNA construct or polynucleotide includes DNA that is processed to an RNA aptamer, that is, an RNA that binds to a ligand through binding mechanism that is not primarily based on Watson-Crick base-pairing (in contrast, for example, to the base-pairing that occurs between complementary, anti-parallel nucleic acid strands to form a double-stranded nucleic acid structure). See, for example, Ellington and Szostak (1990) *Nature,* 346:818-822. Examples of aptamers can be found, for example, in the public Aptamer Database, available on line at aptamer.icmb.utexas.edu (Lee et al. (2004) *Nucleic Acids Res.,* 32(1):D95-100). Aptamers can, however, be monovalent (binding a single ligand) or multivalent (binding more than one individual ligand, e. g., binding one unit of two or more different ligands).

Ligands include any molecule (or part of a molecule) that can be recognized and be bound by a nucleic acid secondary structure by a mechanism not primarily based on Watson-Crick base pairing. In this way, the recognition and binding of ligand and aptamer is analogous to that of antigen and antibody, or of biological effector and receptor. Ligands can include single molecules (or part of a molecule), or a combination of two or more molecules (or parts of a molecule), and can include one or more macromolecular complexes (e. g., polymers, lipid bilayers, liposomes, cellular membranes or other cellular structures, or cell surfaces). Examples of specific ligands include vitamins such as coenzyme $B_{12}$ and thiamine pyrophosphate, flavin mononucleotide, guanine, adenosine, S-adenosylmethionine, S-adenosylhomocysteine, coenzyme A, lysine, tyrosine, dopamine, glucosamine-6-phosphate, caffeine, theophylline, antibiotics such as chloramphenicol and neomycin, herbicides such as glyphosate and dicamba, proteins including viral or phage coat proteins and invertebrate epidermal or digestive tract surface proteins, and RNAs including viral RNA, transfer-RNAs (t-RNAs), ribosomal RNA (rRNA), and RNA polymerases such as RNA-dependent RNA polymerase (RdRP). One class of RNA aptamers are "thermoswitches" that do not bind a ligand but are thermally responsive, that is to say, the aptamer's conformation is determined by temperature; see, for example, Box 3 in Mandal and Breaker (2004) *Nature Rev. Mol. Cell Biol.*, 5:451-463.

Transgene Transcription Units

In some embodiments, the recombinant DNA construct or polynucleotide disclosed herein includes a transgene transcription unit. A transgene transcription unit includes DNA sequence encoding a gene of interest, e. g., a natural protein or a heterologous protein. A gene of interest can be any coding or non-coding sequence from any species (including, but not limited to, non-eukaryotes such as bacteria, and viruses; fungi, protists, plants, invertebrates, and vertebrates. Particular genes of interest are genes encoding one or more proteins conferring resistance to an herbicide and genes encoding at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, a *Bacillus sphaericus* insecticidal protein, and an insecticidal protein produced by any of *Lysinibacillus sphaericus* (*Bacillus sphaericus*), *Brevibacillus laterosporus* (*Bacillus laterosporus*), *Chromobacterium* species, *Chromobacterium subtsugae*, *Paenibacillus* species, *Paenibacillus lentimorbus*, and *Paenibacillus popilliae*. The transgene transcription unit can further include 5' or 3' sequence or both as required for transcription of the transgene.

Introns

In some embodiments, the recombinant DNA construct or polynucleotide includes DNA encoding a spliceable intron. By "intron" is generally meant a segment of DNA (or the RNA transcribed from such a segment) that is located between exons (protein-encoding segments of the DNA or corresponding transcribed RNA), wherein, during maturation of the messenger RNA, the intron present is enzymatically "spliced out" or removed from the RNA strand by a cleavage/ligation process that occurs in the nucleus in eukaryotes. The term "intron" is also applied to non-coding DNA sequences that are transcribed to RNA segments that can be spliced out of a maturing RNA transcript, but are not introns found between protein-coding exons. One example of these are spliceable sequences that that have the ability to enhance expression in plants (in some cases, especially in monocots) of a downstream coding sequence; these spliceable sequences are naturally located in the 5' untranslated region of some plant genes, as well as in some viral genes (e. g., the tobacco mosaic virus 5' leader sequence or "omega" leader described as enhancing expression in plant genes by Gallie and Walbot (1992) *Nucleic Acids Res.*, 20:4631-4638). These spliceable sequences or "expression-enhancing introns" can be artificially inserted in the 5' untranslated region of a plant gene between the promoter but before any protein-coding exons. Examples of such expression-enhancing introns include, but are not limited to, a maize alcohol dehydrogenase (Zm-Adh1), a maize Bronze-1 expression-enhancing intron, a rice actin 1 (Os-Act1) intron, a Shrunken-1 (Sh-1) intron, a maize sucrose synthase intron, a heat shock protein 18 (hsp18) intron, and an 82 kilodalton heat shock protein (hsp82) intron. U.S. Pat. Nos. 5,593,874 and 5,859,347, specifically incorporated by reference herein, describe methods of improving recombinant DNA constructs for use in plants by inclusion of an expression-enhancing intron derived from the 70 kilodalton maize heat shock protein (hsp70) in the non-translated leader positioned 3' from the gene promoter and 5' from the first protein-coding exon.

Ribozymes

In some embodiments, the recombinant DNA construct or polynucleotide includes DNA encoding one or more ribozymes. Ribozymes of particular interest include a self-cleaving ribozyme, a hammerhead ribozyme, or a hairpin ribozyme. In one embodiment, the recombinant DNA construct includes DNA encoding one or more ribozymes that serve to cleave the transcribed RNA to provide defined segments of RNA, such as separate sense or anti-sense single-stranded RNA segments (which in embodiments hybridise to form dsRNA), or an RNA segment having self-complementary nucleotide sequences that form at least partially dsRNA (e. g., in a stem-loop structure) for suppressing a flea beetle target gene.

Gene Suppression Elements

In some embodiments, the recombinant DNA construct or polynucleotide includes DNA encoding additional gene suppression element for suppressing a target gene other than a flea beetle target gene. The target gene to be suppressed can include coding or non-coding sequence or both.

Suitable gene suppression elements are described in detail in U. S. Patent Application Publication 2006/0200878, which disclosure is specifically incorporated herein by reference, and include one or more of:

(a) DNA that includes at least one anti-sense DNA segment that is anti-sense to at least one segment of the gene to be suppressed;

(b) DNA that includes multiple copies of at least one anti-sense DNA segment that is anti-sense to at least one segment of the gene to be suppressed;

(c) DNA that includes at least one sense DNA segment that is at least one segment of the gene to be suppressed;

(d) DNA that includes multiple copies of at least one sense DNA segment that is at least one segment of the gene to be suppressed;

(e) DNA that transcribes to RNA for suppressing the gene to be suppressed by forming double-stranded RNA and includes at least one anti-sense DNA segment that is anti-sense to at least one segment of the gene to be suppressed and at least one sense DNA segment that is at least one segment of the gene to be suppressed;

(f) DNA that transcribes to RNA for suppressing the gene to be suppressed by forming a single double-stranded RNA and includes multiple serial anti-sense DNA segments that are anti-sense to at least one segment of the gene to be suppressed and multiple serial sense DNA segments that are at least one segment of the gene to be suppressed;

(g) DNA that transcribes to RNA for suppressing the gene to be suppressed by forming multiple double strands of RNA and includes multiple anti-sense DNA segments that are anti-sense to at least one segment of the gene to be suppressed and multiple sense DNA segments that are at least one segment of the gene to be suppressed, and wherein the multiple anti-sense DNA segments and the multiple sense DNA segments are arranged in a series of inverted repeats;

(h) DNA that includes nucleotides derived from a plant miRNA;

(i) DNA that includes nucleotides of a siRNA;

(j) DNA that transcribes to an RNA aptamer capable of binding to a ligand; and (k) DNA that transcribes to an RNA aptamer capable of binding to a ligand, and DNA that transcribes to regulatory RNA capable of regulating expression of the gene to be suppressed, wherein the regulation is dependent on the conformation of the regulatory RNA, and the conformation of the regulatory RNA is allosterically affected by the binding state of the RNA aptamer.

In some embodiments, an intron is used to deliver a gene suppression element in the absence of any protein-coding exons (coding sequence). In one example, an intron, such as an expression-enhancing intron (preferred in certain embodiments), is interrupted by embedding within the intron a gene suppression element, wherein, upon transcription, the gene suppression element is excised from the intron. Thus, protein-coding exons are not required to provide the gene suppressing function of the recombinant DNA constructs disclosed herein.

Transcription Regulatory Elements

In some embodiments, the recombinant DNA construct or polynucleotide includes DNA encoding a transcription regulatory element. Transcription regulatory elements include elements that regulate the expression level of the recombinant DNA construct (relative to its expression in the absence of such regulatory elements). Examples of suitable transcription regulatory elements include riboswitches (cis- or trans-acting), transcript stabilizing sequences, and miRNA recognition sites, as described in detail in U. S. Patent Application Publication 2006/0200878, specifically incorporated herein by reference.

Transgenic Plant Cells and Transgenic Plants

The recombinant DNA constructs disclosed herein can be stacked with other recombinant DNA for imparting additional traits (e. g., in the case of transformed plants, traits including herbicide resistance, pest resistance, cold germination tolerance, water deficit tolerance, and the like) for example, by expressing or suppressing other genes. Constructs for coordinated decrease and increase of gene expression are disclosed in U.S. Patent Application Publication 2004/0126845 A1, specifically incorporated by reference.

In certain transgenic plant cells and transgenic plants, it is sometimes desirable to concurrently express a gene of interest while also modulating expression of a flea beetle target gene. Thus, in some embodiments, the transgenic plant contains recombinant DNA further including a gene expression element for expressing at least one gene of interest, and transcription of the recombinant DNA construct for flea beetle control is preferably effected with concurrent transcription of the gene expression element. In embodiments, the transgenic plant expresses DNA encoding a recombinant RNA transcript as disclosed herein for suppression of a flea beetle target gene, and also expresses DNA encoding a non-nucleotide pesticidal agent such as a small-molecule pesticidal agent or a proteinaceous pesticidal agent; such DNAs can be stacked in a single recombinant construct or expression cassette, or alternatively can be expressed from discrete recombinant constructs or expression cassettes. Examples of non-nucleotide pesticidal agents include patatins, plant lectins, phytoecdysteroids, and bacterial insecticidal proteins (e. g., insecticidal proteins from *Bacillus thuringiensis, Xenorhabdus* sp., *Photorhabdus* sp., *Brevibacillus laterosporus* (*Bacillus laterosporus*), *Lysinibacillus sphaericus* (*Bacillus sphaericus*), *Chromobacterium* sp., *Chromobacterium subtsugae, Paenibacillus* sp., *Paenibacillus lentimorbus*, and *Paenibacillus popilliae*). In embodiments, the transgenic plant expresses DNA encoding a recombinant RNA transcript as disclosed herein for suppression of a flea beetle target gene, and also expresses DNA encoding one or more proteins conferring tolerance to an herbicide. Examples of proteins conferring tolerance to an herbicide include 5-enolpyruvylshikimate-3-phosphate synthases (EPSPS; see, e. g., U.S. Pat. Nos. 5,627,061, 5,633, 435 RE39247, 6,040,497, and 5,094,945, and PCT International Application Publications WO04074443 and WO04009761), glyphosate oxidoreductase (GOX; U.S. Pat. No. 5,463,175), glyphosate decarboxylase (PCT International Application Publication WO05003362, U.S. Pat. No. 7,405,347, and U. S. Patent Application Publication 2004/0177399), glyphosate-N-acetyl transferase (GAT; U.S. Pat. No. 7,714,188) conferring tolerance to glyphosate; dicamba monooxygenase conferring tolerance to auxin-like herbicides such as dicamba (U.S. Pat. No. 7,105,724); phosphinothricin acetyltransferase (pat or bar) conferring tolerance to phosphinothricin or glufosinate (U.S. Pat. No. 5,646,024); 2,2-dichloropropionic acid dehalogenase conferring tolerance to 2,2-dichloropropionic acid (Dalapon) (PCT International Application Publication WO9927116); acetohydroxyacid synthase or acetolactate synthase conferring tolerance to acetolactate synthase inhibitors such as sulfonylurea, imidazolinone, triazolopyrimidine, pyrimidyloxybenzoates and phthalide (U.S. Pat. No. 6,225,105); haloarylnitrilase (Bxn) for conferring tolerance to bromoxynil (U.S. Pat. No. 4,810,648); modified acetyl-coenzyme A carboxylase for conferring tolerance to cyclohexanedione (sethoxydim) and aryloxyphenoxypropionate (haloxyfop) (U.S. Pat. No. 6,414,222); dihydropteroate synthase (sul I) for conferring tolerance to sulfonamide herbicides (U.S. Pat. No. 5,719, 046); 32 kDa photosystem II polypeptide (psbA) for conferring tolerance to triazine herbicides (Hirschberg et al., 1983, Science, 222:1346-1349); anthranilate synthase for conferring tolerance to 5-methyltryptophan (U.S. Pat. No. 4,581,847); dihydrodipicolinic acid synthase (dap A) for conferring to tolerance to aminoethyl cysteine (PCT International Application Publication WO8911789); phytoene desaturase (crtl) for conferring tolerance to pyridazinone herbicides such as norflurazon (Japan Patent JP06343473); hydroxyphenylpyruvate dioxygenase, a 4-hydroxyphenylacetic acid oxidase and a 4-hydroxyphenylacetic 1-hydrolase (U.S. Pat. No. 7,304,209) for conferring tolerance to cyclopropylisoxazole herbicides such as isoxaflutole (U.S. Pat. No. 6,268,549); modified protoporphyrinogen oxidase I (protox) for conferring tolerance to protoporphyrinogen oxidase inhibitors (U.S. Pat. No. 5,939,602); aryloxyalkanoate dioxygenase (AAD-1) for conferring tolerance to an herbicide containing an aryloxyalkanoate moiety (WO05107437); a serine hydroxymethyltransferase (US Patent Application Publication 2008/0155716), a glufosinate-tolerant glutamine synthase (US Patent Application Publication 2009/0018016). Examples of such herbicides include phenoxy auxins (such as 2,4-D and dichlorprop), pyridyloxy auxins (such as fluroxypyr and triclopyr), aryloxyphenoxypropionates (AOPP) acetylcoenzyme A carboxylase (ACCase) inhibitors (such as haloxyfop, quizalofop, and diclofop), and 5-substituted phenoxyacetate protoporphyrinogen oxidase IX inhibitors (such as pyraflufen and flumiclorac). The nucleotide sequences of the nucleic acids encoding herbicide-tolerance proteins and the sequences of the herbicide-tolerance proteins, as disclosed in the U. S. patent and patent application publications cited in this paragraph are incorporated herein by reference.

In some embodiments, the recombinant DNA constructs disclosed herein can be transcribed in any plant cell or tissue or in a whole plant of any developmental stage. Transgenic plants can be derived from any monocot or dicot plant, such as, but not limited to, plants of commercial or agricultural interest, such as crop plants (especially crop plants used for human food or animal feed), wood- or pulp-producing trees, vegetable plants, fruit plants, and ornamental plants. Examples of plants of interest include grain crop plants (such as wheat, oat, barley, maize, rye, triticale, rice, millet, sorghum, quinoa, amaranth, and buckwheat); forage crop plants (such as forage grasses and forage dicots including alfalfa, vetch, clover, and the like); oilseed crop plants (such as cotton, safflower, sunflower, soybean, canola, rapeseed, flax, peanuts, and oil palm); tree nuts (such as walnut, cashew, hazelnut, pecan, almond, and the like); sugarcane, coconut, date palm, olive, sugarbeet, tea, and coffee; wood- or pulp-producing trees; vegetable crop plants such as legumes (for example, beans, peas, lentils, alfalfa, peanut), lettuce, asparagus, artichoke, celery, carrot, radish, the brassicas (for example, cabbages, kales, mustards, and other leafy brassicas, broccoli, cauliflower, Brussels sprouts, turnip, kohlrabi), edible cucurbits (for example, cucumbers, melons, summer squashes, winter squashes), edible alliums (for example, onions, garlic, leeks, shallots, chives), edible members of the Solanaceae (for example, tomatoes, eggplants, potatoes, peppers, groundcherries), and edible members of the Chenopodiaceae (for example, beet, chard, spinach, quinoa, amaranth); fruit crop plants such as apple, pear, citrus fruits (for example, orange, lime, lemon, grapefruit, and others), stone fruits (for example, apricot, peach, plum, nectarine), banana, pineapple, grape, kiwifruit, *papaya*, avocado, and berries; plants grown for biomass or biofuel (for example, *Miscanthus* grasses, switchgrass, jatropha, oil palm, eukaryotic microalgae such as *Botryococcus braunii, Chlorella* spp., and *Dunaliella* spp., and eukaryotic macroalgae such as Gracilaria spp., and Sargassum spp.); and ornamental plants including ornamental flowering plants, ornamental trees and shrubs, ornamental groundcovers, and ornamental grasses. Specific plant species of interest in which a recombinant DNA construct is transcribed to provide resistance to flea beetles are plants in the family Brassicaceae, including the *Brassica* species *B. napus, B. juncea, B. carinata, B. rapa, B. oleracea, B. rupestris, B. septiceps, B. nigra, B. narinosa, B. perviridus, B. tournefortii*, and *B. fructiculosa*. Additional plant species of interest in which a recombinant DNA construct is transcribed to provide resistance to flea beetles are *Glycine max, Linum usitatissimum, Zea mays, Carthamus tinctorius, Helianthus annuus, Nicotiana tabacum, Arabidopsis thaliana, Betholettia excelsa, Ricinus communis, Cocos nucifera, Coriandrum sativum, Gossypium* spp., *Arachis hypogaea, Simmondsia chinensis, Solanum tuberosum, Elaeis guineensis, Olea europaea, Oryza sativa, Cucurbita maxim, Hordeum vulgare*, and *Triticum aestivum*.

Also disclosed herein are commodity products produced from a transgenic plant cell, plant, or seed expressing a recombinant DNA construct imparting improved resistance to flea beetles as disclosed herein, including, but not limited to, harvested leaves, roots, shoots, tubers, stems, fruits, seeds, or other parts of a plant, meals, oils, extracts, fermentation or digestion products, crushed or whole grains or seeds of a plant, or any food or non-food product including such commodity products produced from a transgenic plant cell, plant, or seed as disclosed herein. The detection of one or more nucleic acid sequences of the recombinant DNA constructs for flea beetle control as disclosed herein in one or more commodity or commodity products contemplated herein is de facto evidence that the commodity or commodity product contains or is derived from a transgenic plant cell, plant, or seed expressing such a recombinant DNA construct.

Generally a transgenic plant having in its genome a recombinant DNA construct as disclosed herein exhibits increased resistance to an insect infestation, specifically increased resistance to a flea beetle infestation. In various embodiments, for example, where the transgenic plant expresses a recombinant DNA construct for flea beetle control that is stacked with other recombinant DNA for imparting additional traits, the transgenic plant has at least one additional altered trait, relative to a plant lacking the recombinant DNA construct, selected from the group of traits consisting of: (a) improved abiotic stress tolerance;
(b) improved biotic stress tolerance;
(c) modified primary metabolite composition;
(d) modified secondary metabolite composition;
(e) modified trace element, carotenoid, or vitamin composition;
(f) improved yield;
(g) improved ability to use nitrogen, phosphate, or other nutrients;
(h) modified agronomic characteristics;
(i) modified growth or reproductive characteristics; and
(j) improved harvest, storage, or processing quality.

In some embodiments, the transgenic plant is characterized by: improved tolerance of abiotic stress (e. g., tolerance of water deficit or drought, heat, cold, non-optimal nutrient or salt levels, non-optimal light levels) or of biotic stress (e. g., crowding, allelopathy, or wounding); by a modified primary metabolite (e. g., fatty acid, oil, amino acid, protein, sugar, or carbohydrate) composition; a modified secondary metabolite (e. g., alkaloids, terpenoids, polyketides, non-ribosomal peptides, and secondary metabolites of mixed biosynthetic origin) composition; a modified trace element (e. g., iron, zinc), carotenoid (e. g., beta-carotene, lycopene, lutein, zeaxanthin, or other carotenoids and xanthophylls), or vitamin (e. g., tocopherols) composition; improved yield (e. g., improved yield under non-stress conditions or improved yield under biotic or abiotic stress); improved ability to use nitrogen, phosphate, or other nutrients; modified agronomic characteristics (e. g., delayed ripening; delayed senescence; earlier or later maturity; improved shade tolerance; improved resistance to root or stalk lodging; improved resistance to "green snap" of stems; modified photoperiod response); modified growth or reproductive characteristics (e. g., intentional dwarfing; intentional male sterility, useful, e. g., in improved hybridization procedures; improved vegetative growth rate; improved germination; improved male or female fertility); improved harvest, storage, or processing quality (e. g., improved resistance to pests during storage, improved resistance to breakage, improved appeal to consumers); or any combination of these traits.

In another embodiment, transgenic seed, or seed produced by the transgenic plant, has modified primary metabolite (e. g., fatty acid, oil, amino acid, protein, sugar, or carbohydrate) composition, a modified secondary metabolite composition, a modified trace element, carotenoid, or vitamin composition, an improved harvest, storage, or processing quality, or a combination of these. In another embodiment, it can be desirable to change levels of native components of the transgenic plant or seed of a transgenic plant, for example, to decrease levels of an allergenic protein or glycoprotein or of a toxic metabolite.

EXAMPLES

Example 1

This example illustrates non-limiting embodiments of coding DNA sequences useful as target genes for controlling insect species and for making compositions for controlling insects and insect-resistant transgenic plants, and identifies dsRNA trigger sequences useful for controlling insect species. More specifically, embodiments of target genes identified by name (annotation) and sequence identifier (SEQ ID NO.) for controlling flea beetles are provided in SEQ ID NOs:1-859, and embodiments of dsRNA trigger sequences ranging in size from 135 to 352 base pairs and designed to suppress these target genes are provided in SEQ ID NOs.: 860-1718.

TABLE 1

| Target Gene SEQ ID NO. | Trigger SEQ ID NO.* | Target Gene SEQ ID NO. | Trigger SEQ ID NO.* | Target Gene SEQ ID NO. | Trigger SEQ ID NO.* | Target Gene SEQ ID NO. | Trigger SEQ ID NO.* |
|---|---|---|---|---|---|---|---|
| 1 | 860 | 216 | 1075 | 431 | 1290 | 646 | 1505 |
| 2 | 861 | 217 | 1076 | 432 | 1291 | 647 | 1506 |
| 3 | 862 | 218 | 1077 | 433 | 1292 | 648 | 1507 |
| 4 | 863 | 219 | 1078 | 434 | 1293 | 649 | 1508 |
| 5 | 864 | 220 | 1079 | 435 | 1294 | 650 | 1509 |
| 6 | 865 | 221 | 1080 | 436 | 1295 | 651 | 1510 |
| 7 | 866 | 222 | 1081 | 437 | 1296 | 652 | 1511 |
| 8 | 867 | 223 | 1082 | 438 | 1297 | 653 | 1512 |
| 9 | 868 | 224 | 1083 | 439 | 1298 | 654 | 1513 |
| 10 | 869 | 225 | 1084 | 440 | 1299 | 655 | 1514 |
| 11 | 870 | 226 | 1085 | 441 | 1300 | 656 | 1515 |
| 12 | 871 | 227 | 1086 | 442 | 1301 | 657 | 1516 |
| 13 | 872 | 228 | 1087 | 443 | 1302 | 658 | 1517 |
| 14 | 873 | 229 | 1088 | 444 | 1303 | 659 | 1518 |
| 15 | 874 | 230 | 1089 | 445 | 1304 | 660 | 1519 |
| 16 | 875 | 231 | 1090 | 446 | 1305 | 661 | 1520 |
| 17 | 876 | 232 | 1091 | 447 | 1306 | 662 | 1521 |
| 18 | 877 | 233 | 1092 | 448 | 1307 | 663 | 1522 |
| 19 | 878 | 234 | 1093 | 449 | 1308 | 664 | 1523 |
| 20 | 879 | 235 | 1094 | 450 | 1309 | 665 | 1524 |
| 21 | 880 | 236 | 1095 | 451 | 1310 | 666 | 1525 |
| 22 | 881 | 237 | 1096 | 452 | 1311 | 667 | 1526 |
| 23 | 882 | 238 | 1097 | 453 | 1312 | 668 | 1527 |
| 24 | 883 | 239 | 1098 | 454 | 1313 | 669 | 1528 |
| 25 | 884 | 240 | 1099 | 455 | 1314 | 670 | 1529 |
| 26 | 885 | 241 | 1100 | 456 | 1315 | 671 | 1530 |
| 27 | 886 | 242 | 1101 | 457 | 1316 | 672 | 1531 |
| 28 | 887 | 243 | 1102 | 458 | 1317 | 673 | 1532 |
| 29 | 888 | 244 | 1103 | 459 | 1318 | 674 | 1533 |
| 30 | 889 | 245 | 1104 | 460 | 1319 | 675 | 1534 |
| 31 | 890 | 246 | 1105 | 461 | 1320 | 676 | 1535 |
| 32 | 891 | 247 | 1106 | 462 | 1321 | 677 | 1536 |
| 33 | 892 | 248 | 1107 | 463 | 1322 | 678 | 1537 |
| 34 | 893 | 249 | 1108 | 464 | 1323 | 679 | 1538 |
| 35 | 894 | 250 | 1109 | 465 | 1324 | 680 | 1539 |
| 36 | 895 | 251 | 1110 | 466 | 1325 | 681 | 1540 |
| 37 | 896 | 252 | 1111 | 467 | 1326 | 682 | 1541 |
| 38 | 897 | 253 | 1112 | 468 | 1327 | 683 | 1542 |
| 39 | 898 | 254 | 1113 | 469 | 1328 | 684 | 1543 |
| 40 | 899 | 255 | 1114 | 470 | 1329 | 685 | 1544 |
| 41 | 900 | 256 | 1115 | 471 | 1330 | 686 | 1545 |
| 42 | 901 | 257 | 1116 | 472 | 1331 | 687 | 1546 |
| 43 | 902 | 258 | 1117 | 473 | 1332 | 688 | 1547 |
| 44 | 903 | 259 | 1118 | 474 | 1333 | 689 | 1548 |
| 45 | 904 | 260 | 1119 | 475 | 1334 | 690 | 1549 |
| 46 | 905 | 261 | 1120 | 476 | 1335 | 691 | 1550 |
| 47 | 906 | 262 | 1121 | 477 | 1336 | 692 | 1551 |
| 48 | 907 | 263 | 1122 | 478 | 1337 | 693 | 1552 |
| 49 | 908 | 264 | 1123 | 479 | 1338 | 694 | 1553 |
| 50 | 909 | 265 | 1124 | 480 | 1339 | 695 | 1554 |
| 51 | 910 | 266 | 1125 | 481 | 1340 | 696 | 1555 |
| 52 | 911 | 267 | 1126 | 482 | 1341 | 697 | 1556 |
| 53 | 912 | 268 | 1127 | 483 | 1342 | 698 | 1557 |
| 54 | 913 | 269 | 1128 | 484 | 1343 | 699 | 1558 |
| 55 | 914 | 270 | 1129 | 485 | 1344 | 700 | 1559 |
| 56 | 915 | 271 | 1130 | 486 | 1345 | 701 | 1560 |
| 57 | 916 | 272 | 1131 | 487 | 1346 | 702 | 1561 |
| 58 | 917 | 273 | 1132 | 488 | 1347 | 703 | 1562 |
| 59 | 918 | 274 | 1133 | 489 | 1348 | 704 | 1563 |
| 60 | 919 | 275 | 1134 | 490 | 1349 | 705 | 1564 |
| 61 | 920 | 276 | 1135 | 491 | 1350 | 706 | 1565 |
| 62 | 921 | 277 | 1136 | 492 | 1351 | 707 | 1566 |
| 63 | 922 | 278 | 1137 | 493 | 1352 | 708 | 1567 |
| 64 | 923 | 279 | 1138 | 494 | 1353 | 709 | 1568 |
| 65 | 924 | 280 | 1139 | 495 | 1354 | 710 | 1569 |
| 66 | 925 | 281 | 1140 | 496 | 1355 | 711 | 1570 |
| 67 | 926 | 282 | 1141 | 497 | 1356 | 712 | 1571 |
| 68 | 927 | 283 | 1142 | 498 | 1357 | 713 | 1572 |
| 69 | 928 | 284 | 1143 | 499 | 1358 | 714 | 1573 |
| 70 | 929 | 285 | 1144 | 500 | 1359 | 715 | 1574 |
| 71 | 930 | 286 | 1145 | 501 | 1360 | 716 | 1575 |
| 72 | 931 | 287 | 1146 | 502 | 1361 | 717 | 1576 |
| 73 | 932 | 288 | 1147 | 503 | 1362 | 718 | 1577 |
| 74 | 933 | 289 | 1148 | 504 | 1363 | 719 | 1578 |
| 75 | 934 | 290 | 1149 | 505 | 1364 | 720 | 1579 |
| 76 | 935 | 291 | 1150 | 506 | 1365 | 721 | 1580 |
| 77 | 936 | 292 | 1151 | 507 | 1366 | 722 | 1581 |
| 78 | 937 | 293 | 1152 | 508 | 1367 | 723 | 1582 |
| 79 | 938 | 294 | 1153 | 509 | 1368 | 724 | 1583 |
| 80 | 939 | 295 | 1154 | 510 | 1369 | 725 | 1584 |
| 81 | 940 | 296 | 1155 | 511 | 1370 | 726 | 1585 |
| 82 | 941 | 297 | 1156 | 512 | 1371 | 727 | 1586 |
| 83 | 942 | 298 | 1157 | 513 | 1372 | 728 | 1587 |
| 84 | 943 | 299 | 1158 | 514 | 1373 | 729 | 1588 |
| 85 | 944 | 300 | 1159 | 515 | 1374 | 730 | 1589 |
| 86 | 945 | 301 | 1160 | 516 | 1375 | 731 | 1590 |
| 87 | 946 | 302 | 1161 | 517 | 1376 | 732 | 1591 |
| 88 | 947 | 303 | 1162 | 518 | 1377 | 733 | 1592 |
| 89 | 948 | 304 | 1163 | 519 | 1378 | 734 | 1593 |
| 90 | 949 | 305 | 1164 | 520 | 1379 | 735 | 1594 |
| 91 | 950 | 306 | 1165 | 521 | 1380 | 736 | 1595 |
| 92 | 951 | 307 | 1166 | 522 | 1381 | 737 | 1596 |
| 93 | 952 | 308 | 1167 | 523 | 1382 | 738 | 1597 |
| 94 | 953 | 309 | 1168 | 524 | 1383 | 739 | 1598 |
| 95 | 954 | 310 | 1169 | 525 | 1384 | 740 | 1599 |
| 96 | 955 | 311 | 1170 | 526 | 1385 | 741 | 1600 |
| 97 | 956 | 312 | 1171 | 527 | 1386 | 742 | 1601 |
| 98 | 957 | 313 | 1172 | 528 | 1387 | 743 | 1602 |
| 99 | 958 | 314 | 1173 | 529 | 1388 | 744 | 1603 |
| 100 | 959 | 315 | 1174 | 530 | 1389 | 745 | 1604 |
| 101 | 960 | 316 | 1175 | 531 | 1390 | 746 | 1605 |
| 102 | 961 | 317 | 1176 | 532 | 1391 | 747 | 1606 |
| 103 | 962 | 318 | 1177 | 533 | 1392 | 748 | 1607 |
| 104 | 963 | 319 | 1178 | 534 | 1393 | 749 | 1608 |
| 105 | 964 | 320 | 1179 | 535 | 1394 | 750 | 1609 |
| 106 | 965 | 321 | 1180 | 536 | 1395 | 751 | 1610 |
| 107 | 966 | 322 | 1181 | 537 | 1396 | 752 | 1611 |
| 108 | 967 | 323 | 1182 | 538 | 1397 | 753 | 1612 |
| 109 | 968 | 324 | 1183 | 539 | 1398 | 754 | 1613 |
| 110 | 969 | 325 | 1184 | 540 | 1399 | 755 | 1614 |
| 111 | 970 | 326 | 1185 | 541 | 1400 | 756 | 1615 |
| 112 | 971 | 327 | 1186 | 542 | 1401 | 757 | 1616 |
| 113 | 972 | 328 | 1187 | 543 | 1402 | 758 | 1617 |
| 114 | 973 | 329 | 1188 | 544 | 1403 | 759 | 1618 |
| 115 | 974 | 330 | 1189 | 545 | 1404 | 760 | 1619 |
| 116 | 975 | 331 | 1190 | 546 | 1405 | 761 | 1620 |
| 117 | 976 | 332 | 1191 | 547 | 1406 | 762 | 1621 |
| 118 | 977 | 333 | 1192 | 548 | 1407 | 763 | 1622 |
| 119 | 978 | 334 | 1193 | 549 | 1408 | 764 | 1623 |
| 120 | 979 | 335 | 1194 | 550 | 1409 | 765 | 1624 |
| 121 | 980 | 336 | 1195 | 551 | 1410 | 766 | 1625 |
| 122 | 981 | 337 | 1196 | 552 | 1411 | 767 | 1626 |
| 123 | 982 | 338 | 1197 | 553 | 1412 | 768 | 1627 |
| 124 | 983 | 339 | 1198 | 554 | 1413 | 769 | 1628 |
| 125 | 984 | 340 | 1199 | 555 | 1414 | 770 | 1629 |
| 126 | 985 | 341 | 1200 | 556 | 1415 | 771 | 1630 |
| 127 | 986 | 342 | 1201 | 557 | 1416 | 772 | 1631 |
| 128 | 987 | 343 | 1202 | 558 | 1417 | 773 | 1632 |
| 129 | 988 | 344 | 1203 | 559 | 1418 | 774 | 1633 |

TABLE 1-continued

| Target Gene SEQ ID NO. | Trigger SEQ ID NO.* | Target Gene SEQ ID NO. | Trigger SEQ ID NO.* | Target Gene SEQ ID NO. | Trigger SEQ ID NO.* | Target Gene SEQ ID NO. | Trigger SEQ ID NO.* |
|---|---|---|---|---|---|---|---|
| 130 | 989 | 345 | 1204 | 560 | 1419 | 775 | 1634 |
| 131 | 990 | 346 | 1205 | 561 | 1420 | 776 | 1635 |
| 132 | 991 | 347 | 1206 | 562 | 1421 | 777 | 1636 |
| 133 | 992 | 348 | 1207 | 563 | 1422 | 778 | 1637 |
| 134 | 993 | 349 | 1208 | 564 | 1423 | 779 | 1638 |
| 135 | 994 | 350 | 1209 | 565 | 1424 | 780 | 1639 |
| 136 | 995 | 351 | 1210 | 566 | 1425 | 781 | 1640 |
| 137 | 996 | 352 | 1211 | 567 | 1426 | 782 | 1641 |
| 138 | 997 | 353 | 1212 | 568 | 1427 | 783 | 1642 |
| 139 | 998 | 354 | 1213 | 569 | 1428 | 784 | 1643 |
| 140 | 999 | 355 | 1214 | 570 | 1429 | 785 | 1644 |
| 141 | 1000 | 356 | 1215 | 571 | 1430 | 786 | 1645 |
| 142 | 1001 | 357 | 1216 | 572 | 1431 | 787 | 1646 |
| 143 | 1002 | 358 | 1217 | 573 | 1432 | 788 | 1647 |
| 144 | 1003 | 359 | 1218 | 574 | 1433 | 789 | 1648 |
| 145 | 1004 | 360 | 1219 | 575 | 1434 | 790 | 1649 |
| 146 | 1005 | 361 | 1220 | 576 | 1435 | 791 | 1650 |
| 147 | 1006 | 362 | 1221 | 577 | 1436 | 792 | 1651 |
| 148 | 1007 | 363 | 1222 | 578 | 1437 | 793 | 1652 |
| 149 | 1008 | 364 | 1223 | 579 | 1438 | 794 | 1653 |
| 150 | 1009 | 365 | 1224 | 580 | 1439 | 795 | 1654 |
| 151 | 1010 | 366 | 1225 | 581 | 1440 | 796 | 1655 |
| 152 | 1011 | 367 | 1226 | 582 | 1441 | 797 | 1656 |
| 153 | 1012 | 368 | 1227 | 583 | 1442 | 798 | 1657 |
| 154 | 1013 | 369 | 1228 | 584 | 1443 | 799 | 1658 |
| 155 | 1014 | 370 | 1229 | 585 | 1444 | 800 | 1659 |
| 156 | 1015 | 371 | 1230 | 586 | 1445 | 801 | 1660 |
| 157 | 1016 | 372 | 1231 | 587 | 1446 | 802 | 1661 |
| 158 | 1017 | 373 | 1232 | 588 | 1447 | 803 | 1662 |
| 159 | 1018 | 374 | 1233 | 589 | 1448 | 804 | 1663 |
| 160 | 1019 | 375 | 1234 | 590 | 1449 | 805 | 1664 |
| 161 | 1020 | 376 | 1235 | 591 | 1450 | 806 | 1665 |
| 162 | 1021 | 377 | 1236 | 592 | 1451 | 807 | 1666 |
| 163 | 1022 | 378 | 1237 | 593 | 1452 | 808 | 1667 |
| 164 | 1023 | 379 | 1238 | 594 | 1453 | 809 | 1668 |
| 165 | 1024 | 380 | 1239 | 595 | 1454 | 810 | 1669 |
| 166 | 1025 | 381 | 1240 | 596 | 1455 | 811 | 1670 |
| 167 | 1026 | 382 | 1241 | 597 | 1456 | 812 | 1671 |
| 168 | 1027 | 383 | 1242 | 598 | 1457 | 813 | 1672 |
| 169 | 1028 | 384 | 1243 | 599 | 1458 | 814 | 1673 |
| 170 | 1029 | 385 | 1244 | 600 | 1459 | 815 | 1674 |
| 171 | 1030 | 386 | 1245 | 601 | 1460 | 816 | 1675 |
| 172 | 1031 | 387 | 1246 | 602 | 1461 | 817 | 1676 |
| 173 | 1032 | 388 | 1247 | 603 | 1462 | 818 | 1677 |
| 174 | 1033 | 389 | 1248 | 604 | 1463 | 819 | 1678 |
| 175 | 1034 | 390 | 1249 | 605 | 1464 | 820 | 1679 |
| 176 | 1035 | 391 | 1250 | 606 | 1465 | 821 | 1680 |
| 177 | 1036 | 392 | 1251 | 607 | 1466 | 822 | 1681 |
| 178 | 1037 | 393 | 1252 | 608 | 1467 | 823 | 1682 |
| 179 | 1038 | 394 | 1253 | 609 | 1468 | 824 | 1683 |
| 180 | 1039 | 395 | 1254 | 610 | 1469 | 825 | 1684 |
| 181 | 1040 | 396 | 1255 | 611 | 1470 | 826 | 1685 |
| 182 | 1041 | 397 | 1256 | 612 | 1471 | 827 | 1686 |
| 183 | 1042 | 398 | 1257 | 613 | 1472 | 828 | 1687 |
| 184 | 1043 | 399 | 1258 | 614 | 1473 | 829 | 1688 |
| 185 | 1044 | 400 | 1259 | 615 | 1474 | 830 | 1689 |
| 186 | 1045 | 401 | 1260 | 616 | 1475 | 831 | 1690 |
| 187 | 1046 | 402 | 1261 | 617 | 1476 | 832 | 1691 |
| 188 | 1047 | 403 | 1262 | 618 | 1477 | 833 | 1692 |
| 189 | 1048 | 404 | 1263 | 619 | 1478 | 834 | 1693 |
| 190 | 1049 | 405 | 1264 | 620 | 1479 | 835 | 1694 |
| 191 | 1050 | 406 | 1265 | 621 | 1480 | 836 | 1695 |
| 192 | 1051 | 407 | 1266 | 622 | 1481 | 837 | 1696 |
| 193 | 1052 | 408 | 1267 | 623 | 1482 | 838 | 1697 |
| 194 | 1053 | 409 | 1268 | 624 | 1483 | 839 | 1698 |
| 195 | 1054 | 410 | 1269 | 625 | 1484 | 840 | 1699 |
| 196 | 1055 | 411 | 1270 | 626 | 1485 | 841 | 1700 |
| 197 | 1056 | 412 | 1271 | 627 | 1486 | 842 | 1701 |
| 198 | 1057 | 413 | 1272 | 628 | 1487 | 843 | 1702 |
| 199 | 1058 | 414 | 1273 | 629 | 1488 | 844 | 1703 |
| 200 | 1059 | 415 | 1274 | 630 | 1489 | 845 | 1704 |
| 201 | 1060 | 416 | 1275 | 631 | 1490 | 846 | 1705 |
| 202 | 1061 | 417 | 1276 | 632 | 1491 | 847 | 1706 |
| 203 | 1062 | 418 | 1277 | 633 | 1492 | 848 | 1707 |
| 204 | 1063 | 419 | 1278 | 634 | 1493 | 849 | 1708 |
| 205 | 1064 | 420 | 1279 | 635 | 1494 | 850 | 1709 |
| 206 | 1065 | 421 | 1280 | 636 | 1495 | 851 | 1710 |
| 207 | 1066 | 422 | 1281 | 637 | 1496 | 852 | 1711 |
| 208 | 1067 | 423 | 1282 | 638 | 1497 | 853 | 1712 |
| 209 | 1068 | 424 | 1283 | 639 | 1498 | 854 | 1713 |
| 210 | 1069 | 425 | 1284 | 640 | 1499 | 855 | 1714 |
| 211 | 1070 | 426 | 1285 | 641 | 1500 | 856 | 1715 |
| 212 | 1071 | 427 | 1286 | 642 | 1501 | 857 | 1716 |
| 213 | 1072 | 428 | 1287 | 643 | 1502 | 858 | 1717 |
| 214 | 1073 | 429 | 1288 | 644 | 1503 | 859 | 1718 |
| 215 | 1074 | 430 | 1289 | 645 | 1504 | | |

*Trigger sequences are provided for the anti-sense strand of the dsRNA trigger in 5' to 3' direction.
** T44966 and T44967 are positive controls based on a *Phyllotreta striolata* arginine kinase mRNA disclosed in Zhao et al. (2008), Eur. J. Entomol., 5:815.

The embodiments of dsRNA trigger sequences provided in Table 1 are generally useful for RNA-mediated suppression of the corresponding target gene identified in Table 1. These dsRNA triggers are useful for controlling insects, especially flea beetles, including the source species from which the target genes in Table 1 were identified. RNA-mediated suppression of one or more of the target genes provided in Table 1, or use of one or more of the dsRNA triggers provided in Table 1, is useful for causing mortality or stunting, or otherwise controlling, target insect species in the following genera: *Altica, Anthobiodes, Aphthona, Aphthonaltica, Aphthonoides, Apteopeda, Argopistes, Argopus, Arrhenocoela, Batophila, Blepharida, Chaetocnema, Clitea, Crepidodera, Derocrepis, Dibolia, Disonycha, Epitrix, Hermipyxis, Hermaeophaga, Hespera, Hippuriphila, Horaia, Hyphasis, Lipromima, Liprus, Longitarsus, Luperomorpha, Lythraria, Manobia, Mantura, Meishania, Minota, Mniophila, Neicrepidodera, Nonarthra, Novofoudrasia, Ochrosis, Oedionychis, Oglobinia, Omeisphaera, Ophrida, Orestia, Paragopus, Pentamesa, Philopona, Phygasia, Phyllotreta, Podagrica, Podagricomela, Podontia, Pseudodera, Psylliodes, Sangariola, Sinaltica, Sphaeroderma, Systena, Trachyaphthona, Xuthea,* and *Zipangia*. In embodiments, compositions including a dsRNA trigger for suppression of one or more of the target genes provided in Table 1 (e. g., a composition including an effective amount of one or more of the dsRNA triggers provided in Table 1) are useful for controlling at least one of *Altica ambiens* (alder flea beetle), *Altica canadensis* (prairie flea beetle), *Altica chalybaea* (grape flea beetle), *Altica prasina* (poplar flea beetle), *Altica rosae* (rose flea beetle), *Altica sylvia* (blueberry flea beetle), *Altica ulmi* (elm flea beetle), *Chaetocnema pulicaria* (corn flea beele), *Chaetocnema conofinis* (sweet potato flea beetle), *Epitrix cucumeris* (potato flea beetle), *Systena blanda* (palestripped fleabeetle), and *Systena frontalis* (redheaded flea beetle), thus preventing or treating plant infestation by these species. For example, a composition including an effective amount of one or more of the dsRNA triggers provided in Table 1 is useful for preventing or treating infestation of potato plants by *Epitrix cucumeris* (potato flea beetle).

In embodiments, RNA-mediated suppression of one or more of the target genes provided in Table 1, or use of one or more of the dsRNA triggers provided in Table 1, is useful for causing mortality or stunting in flea beetle species in the genera *Phyllotreta* and *Psylliodes*, thus preventing or treating plant infestation by these species. In specific embodiments, RNA-mediated suppression of one or more of the target genes provided in Table 1, or use of one or more of the dsRNA triggers provided in Table 1, is useful for causing mortality or stunting in at least one flea beetle species selected from the group consisting of *Phyllotreta armoraciae* (horseradish flea beetle), *Phyllotreta cruciferae* (canola flea beetle), *Phyllotreta pusilla* (western black flea beetle), *Phyllotreta nemorum* (striped turnip flea beetle), *Phyllotreta atra* (turnip flea beetle), *Phyllotreta robusta* (garden flea beetle), *Phyllotreta striolata* (striped flea beetle), *Phyllotreta undulata, Psylliodes chrysocephala,* and *Psylliodes punctulata* (hop flea beetle). In embodiments, RNA-mediated suppression of one or more of the target genes having a sequence selected from the group consisting of SEQ ID NOs:1-296 is used to cause mortality or stunting in *Phyllotreta atra* (turnip flea beetle) adults or larvae, for example, by contacting *Phyllotreta atra* adults, larvae, or eggs with an effective amount of a dsRNA trigger including a sequence selected from the group consisting of SEQ ID NOs:860-1155. In embodiments, RNA-mediated suppression of one or more of the target genes having a sequence selected from the group consisting of SEQ ID NOs:297-532 is used to cause mortality or stunting in *Phyllotreta cruciferae* (canola flea beetle) adults or larvae, for example, by contacting *Phyllotreta cruciferae* adults, larvae, or eggs with an effective amount of a dsRNA trigger including a sequence selected from the group consisting of SEQ ID NOs:1156-1391. In embodiments, RNA-mediated suppression of one or more of the target genes having a sequence selected from the group consisting of SEQ ID NOs:533-551 is used to cause mortality or stunting in *Phyllotreta striolata* (striped flea beetle) adults or larvae, for example, by contacting *Phyllotreta striolata* adults, larvae, or eggs with an effective amount of a dsRNA trigger including a sequence selected from the group consisting of SEQ ID NOs:1392-1410. In embodiments, RNA-mediated suppression of one or more of the target genes having a sequence selected from the group consisting of SEQ ID NOs:552-859 is used to cause mortality or stunting in *Psylliodes chrysocephala* adults or larvae, for example, by contacting *Psylliodes chrysocephala* adults, larvae, or eggs with an effective amount of a dsRNA trigger including a sequence selected from the group consisting of SEQ ID NOs:1411-1718.

Plants which can be protected by such infestation by transgenic expression or topical application of one or more of the dsRNA triggers provided in Table 1 include any plant species or variety that is subject to infestation by flea beetles, especially plants of economic importance, including ornamental plants and crop plants. Embodiments of such plants include plants in the family Brassicaceae (mustard family), such as a plant in the genus *Brassica* including, for example, one of the following: *B. napus* (rapeseed, including cultivars such as canola and rutabaga), *B. juncea* (Indian mustard), *B. carinata* (Abyssinian mustard), *B. rapa* (turnip), *B. oleracea* (wild cabbage, including domesticated cultivars such as, kale, cabbage, broccoli, cauliflower, brussels sprouts, etc.) *B. rupestris* (brown mustard), *B. septiceps* (seventop mustard), *B. nigra* (black mustard), *B. narinosa* (broadbeaked mustard), *B. perviridus* (mustard spinach), *B. tournefortii* (asian mustard), and *B. fructiculosa* (Mediterranean cabbage). In additional embodiments, the target plants may include, but not limited to, one of the following: *Glycine max* (soybean), *Linum usitatissimum* (linseed/flax), *Zea mays* (maize), *Carthamus tinctorius* (safflower), *Helianthus annuus* (sunflower), *Nicotiana tabacum* (tobacco), *Arabidopsis thaliana, Betholettia excelsa* (Brazil nut), *Ricinus communis* (castor bean), *Cocos nucifera* (coconut), *Coriandrum sativum* (coriander), *Gossypium* spp. (cotton), *Arachis hypogaea* (groundnut or peanut), *Simmondsia chinensis* (jojoba), *Solanum tuberosum* (potato) *Elaeis guineensis* (oil palm), *Olea europaea* (olive), *Oryza sativa* (rice), *Cucurbita maxima* (squash), *Hordeum vulgare* (barley), and *Triticum aestivum* (wheat).

An aspect includes compositions including an effective amount of one or more of the dsRNA triggers provided in Table 1 for topical treatment of a plant to be treated for, or be protected from, flea beetle infestation. Another aspect includes a recombinant DNA construct encoding at least one strand of at least one the dsRNA triggers provided in Table 1 for transgenic expression in a plant that has improved resistance to flea beetle infestation, in comparison to a plant not expressing such a construct.

Example 2

This example illustrates non-limiting embodiments of testing the efficacy of dsRNA trigger sequences and validating the triggers' utility for suppressing coding DNA sequences useful as target genes for controlling insect species. More specifically this example illustrates a method including contacting an insect, such as a flea beetle adult or larva, with one or more dsRNA triggers designed to cause stunting or mortality in the insect. Other embodiments include methods where the dsRNA trigger is delivered to the insect by oral delivery (e. g., on or in a food material ingested by the insect), or through non-oral delivery (e. g., delivery through the insect's cuticle, or delivery by contacting an egg of the insect).

In one embodiment, a feeding assay is used to determine efficacy of a dsRNA trigger in causing stunting or mortality in insects, such as flea beetles. To test the efficacy of the dsRNA triggers to kill or stunt flea beetles, a single discriminating dose (for example, 100 nanograms/milliliter) is used to identify dsRNA triggers with measurable ability to kill or stunt flea beetles at that dose. A negative control dsRNA trigger, such as a dsRNA targetting green fluorescent protein (GFP), is also included in the assay. Each dsRNA trigger is coated evenly onto 1.0 centimeter diameter canola leaf discs and placed in multiwell trays, with 2 male and 2 female adult flea beetles or 4 flea beetle larvae per well. Every 24 hours for a set period (e. g., 2 weeks), new, freshly-coated leaves are provided. Stunting and mortality are scored periodically (e. g., daily, or every 2 or 3 days).

The dsRNA triggers that show efficacy in this single-dose assay are tested further. Using a similar protocol, varying doses of dsRNA triggers are tested, as described above, to determine the LC50 dose for each of the active dsRNAs. Bioassays include 12-24 insects per dose, performed in triplicate. Stunting and mortality is assessed over a 2 week period, scored on every third day.

The dsRNA trigger sequences that are confirmed to be effective in suppressing a target gene in a sequence-specific manner are useful for identifying efficacious RNA delivery agents and formulations. The insecticidal activity of formulations containing the dsRNA triggers can be optimized by various techniques, such as modifying the chemical entities in the formulation or modifying the ratio of the chemical components in the formulation. Non-limiting examples of delivery agents and formulations are provided in Example 5.

Example 3

This example illustrates non-limiting embodiments of methods for validating dsRNA trigger efficacy for suppressing or silencing a target gene in an insect cell or causing stunting or mortality in an insect. More specifically this example illustrates methods for testing dsRNA triggers for efficacy in preventing or treating flea beetle infestations in whole plants.

Polynucleotides (such as the dsRNA trigger sequences described in Examples 1 and 2) that have been confirmed to be effective in suppressing a target gene in a sequence-specific manner are further evaluated in whole plant assays. In one method, the polynucleotides (e. g., dsRNA triggers) are applied directly to the insect surface (e. g. by spraying or dusting). In another method, the polynucleotides are provided to the insect in an insect diet (e. g., in a bacterial or plant cell expressing a dsRNA trigger such as a hairpin form of a dsRNA trigger, or in an artificial bait containing RNA). Stunting and mortality are scored periodically, as described in Example 2.

In various methods that are also appropriate for large-scale application (e. g., to fields of crop plants), the polynucleotide is applied in a foliar application through aerial or terrestrial spraying or dusting or chemigation on the leaf surface to control early season damage from the adult stage of the life cycle, or applied as a seed treatment to control larval or adult stages of the insect life cycle, or applied as a soil in-furrow or drench application to control larval or adult stages of the insect life cycle. An example of a foliar testing regime includes treating the plant immediately after emergence from the ground and evaluating foliar damage caused by adult flea beetles 1-2 weeks after plant emergence. For in-furrow or seed treatment similar timing for damage evaluation is followed.

Example 4

The polynucleotides are generally designed to modulate expression by inducing regulation or suppression of an insect target gene and are designed to have a nucleotide sequence essentially identical or essentially complementary to the nucleotide sequence an insect target gene or cDNA (e. g., SEQ ID NOs:1-859) or to the sequence of RNA transcribed from an insect target gene, which can be coding sequence or non-coding sequence. These effective polynucleotide molecules that modulate expression are referred to herein as a "trigger", or "triggers". This example describes non-limiting techniques useful in the design and selection of polynucleotides as "triggers" to modulate expression of an insect target gene.

Selection of Polynucleotide Triggers by "Tiling"

Polynucleotides of use in the compositions and methods disclosed herein need not be of the full length of a target gene, and in many embodiments are of much shorter length in comparison to the target gene. An example of a technique that is useful for selecting effective triggers is "tiling", or evaluation of polynucleotides corresponding to adjacent or partially overlapping segments of a target gene.

Effective polynucleotide "triggers" can be identified by "tiling" gene targets in selected length fragments, e. g., fragments of 200-300 nucleotides in length, with partially overlapping regions, e. g., of about 25 nucleotides, along the length of the target gene. To suppress a single gene, trigger sequences are designed to correspond to (have a nucleotide identity or complementarity with) regions that are unique to the target gene; the selected region of the target gene can include coding sequence or non-coding sequence (e. g., promoter regions, 3' untranslated regions, introns and the like) or a combination of both.

Where it is of interest to design a target effective in suppressing multiple target genes, the multiple target gene sequences are aligned and polynucleotide triggers designed to correspond to regions with high sequence homology in common among the multiple targets. Conversely, where it is of interest to design a target effective in selectively suppressing one among multiple target sequences, the multiple target gene sequences are aligned and polynucleotide triggers designed to correspond to regions with no or low sequence homology in common among the multiple targets.

In a non-limiting example, anti-sense single-stranded RNA triggers are designed for each of the target genes listed in Table 1 as follows. Multiple anti-sense single-stranded RNA triggers, each of 200-300 nucleotides in length and with a sequence corresponding to (e. g., for anti-sense triggers, complementary to) a fragment of a target gene having a sequence selected from SEQ ID NOs:1-859 are designed so that each trigger's sequence overlaps about 25 nucleotides of the next adjacent trigger's sequence, in such a way that the multiple triggers in combination cover the full length of the target gene. (Sense triggers are designed in an analogous fashion, where the trigger sequence is identical to a fragment of the target gene. Similarly, double-stranded triggers can be designed by providing pairs of sense and anti-sense triggers, each pair of triggers overlapping the next adjacent pair of triggers.)

The polynucleotide triggers are tested by any convenient means for efficacy in silencing the insect target gene. Examples of a suitable test include the bioassays described herein in the working Examples. Another test involves the topical application of the polynucleotide triggers either directly to individual insects or to the surface of a plant to be protected from an insect infestation. One desired result of treatment with a polynucleotide as disclosed herein is prevention or control of an insect infestation, e. g., by inducing in an insect a physiological or behavioural change such as, but not limited to, growth stunting, increased mortality, decrease in reproductive capacity, decrease in or cessation of feeding behavior or movement, or decrease in or cessation of metamorphosis stage development. Another desired result of treatment with a polynucleotide as disclosed herein is provision of a plant that exhibits improved resistance to an insect infestation.

The tiling procedure can be repeated, if desired. A polynucleotide trigger found to provide desired activity can itself be subjected to a tiling procedure. For example, multiple overlapping anti-sense single-stranded RNA triggers are designed, each of 50-60 nucleotides in length and with a sequence corresponding to (e. g., for anti-sense triggers, complementary to) the fragment of a target gene having a sequence selected from SEQ ID NOs:1-859 for which a single polynucleotide trigger of 300 nucleotides was found to be effective. Additional rounds of tiling analysis can be carried out, where triggers as short as 18, 19, 20, or 21 nucleotides are tested.

Effective polynucleotide triggers of any size can be used, alone or in combination, in the various methods disclosed herein. In some embodiments, a single polynucleotide trigger is used to make a composition (e. g., a composition for topical application, or a recombinant DNA construct useful for making a transgenic plant). In other embodiments, a mixture or pool of different polynucleotide triggers is used; in such cases the polynucleotide triggers can be for a single target gene or for multiple target genes. In some embodiments, a polynucleotide trigger is designed to target different regions of the target gene, e. g., a trigger can include multiple segments that correspond to different exon regions of the target gene, and "spacer" nucleotides which do not correspond to a target gene can optionally be used in between or adjacent to the segments.

Thermodynamic Considerations in Selecting Polynucleotide Triggers

Polynucleotide triggers can be designed or their sequence optimised using thermodynamic considerations. For example, polynucleotide triggers can be selected based on the thermodynamics controlling hybridization between one nucleic acid strand (e. g., a polynucleotide trigger or an individual siRNA) and another (e. g., a target gene transcript)

Methods and algorithms to predict nucleotide sequences that are likely to be effective at RNAi-mediated silencing of a target gene are known in the art. Non-limiting examples of such methods and algorithms include "i-score", described by Ichihara et al. (2007) *Nucleic Acids Res.*, 35(18): 123e; "Oligowalk", publicly available at rna.urmc.rochester.edu/servers/oligowalk and described by Lu et al. (2008) *Nucleic Acids Res.*, 36:W104-108; and "Reynolds score", described by Khovorova et al. (2004) *Nature Biotechnol.*, 22:326-330.

Permitted Mismatches

By "essentially identical" or "essentially complementary" is meant that the trigger polynucleotide (or at least one strand of a double-stranded polynucleotide) has sufficient identity or complementarity to the target gene or to the RNA transcribed from a target gene (e. g., the transcript) to suppress expression of a target gene (e. g., to effect a reduction in levels or activity of the target gene transcript and/or encoded protein). Polynucleotides need not have 100 percent identity or complementarity to a target gene or to the RNA transcribed from a target gene to suppress expression of the target gene (e. g., to effect a reduction in levels or activity of the target gene transcript or encoded protein, or to provide control of an insect species). In some embodiments, the polynucleotide or a portion thereof is designed to be essentially identical to, or essentially complementary to, a sequence of at least 18 or 19 contiguous nucleotides in either the target gene or the RNA transcribed from the target gene. In some embodiments, the polynucleotide or a portion thereof is designed to be exactly identical to, or exactly complementary to, a sequence of 21 contiguous nucleotides in either the target gene or the RNA transcribed from the target gene. In certain embodiments, an "essentially identical" polynucleotide has 100 percent sequence identity or at least about 83, 84, 85, 86, 87, 88, 89, 90, 91, 92, 93, 94, 95, 96, 97, 98, or 99 percent sequence identity when compared to the sequence of 18 or more contiguous nucleotides in either the endogenous target gene or to an RNA transcribed from the target gene. In certain embodiments, an "essentially complementary" polynucleotide has 100 percent sequence complementarity or at least about 83, 84, 85, 86, 87, 88, 89, 90, 91, 92, 93, 94, 95, 96, 97, 98, or 99 percent sequence complementarity when compared to the sequence of 18 or more contiguous nucleotides in either the target gene or RNA transcribed from the target gene.

Polynucleotides containing mismatches to the target gene or transcript can be used in certain embodiments of the compositions and methods disclosed herein. In some embodiments, the polynucleotide includes at least 18 or at least 19 contiguous nucleotides that are essentially identical or essentially complementary to a segment of equivalent length in the target gene or target gene's transcript. In certain embodiments, a polynucleotide of 19 contiguous nucleotides that is essentially identical or essentially complementary to a segment of equivalent length in the target gene or target gene's transcript can have 1 or 2 mismatches to the target gene or transcript (i. e., 1 or 2 mismatches between the polynucleotide's 19 contiguous nucleotides and the segment of equivalent length in the target gene or target gene's transcript). In certain embodiments, a polynucleotide of 20 or more nucleotides that contains a contiguous 19 nucleotide span of identity or complementarity to a segment of equivalent length in the target gene or target gene's transcript can have 1 or 2 mismatches to the target gene or transcript. In certain embodiments, a polynucleotide of 21 continuous nucleotides that is essentially identical or essentially complementary to a segment of equivalent length in the target gene or target gene's transcript can have 1, 2, or 3 mismatches to the target gene or transcript. In certain embodiments, a polynucleotide of 22 or more nucleotides that contains a contiguous 21 nucleotide span of identity or complementarity to a segment of equivalent length in the target gene or target gene's transcript can have 1, 2, or 3 mismatches to the target gene or transcript.

In designing polynucleotides with mismatches to an endogenous target gene or to an RNA transcribed from the target gene, mismatches of certain types and at certain positions that are more likely to be tolerated can be used. In certain exemplary embodiments, mismatches formed between adenine and cytosine or guanosine and uracil residues are used as described by Du et al. (2005) *Nucleic Acids Res.*, 33:1671-1677. In some embodiments, mismatches in 19 base-pair overlap regions are located at the low tolerance positions 5, 7, 8 or 11 (from the 5' end of a 19-nucleotide target), at medium tolerance positions 3, 4, and 12-17(from the 5' end of a 19-nucleotide target), and/or at the high tolerance positions at either end of the region of complementarity, e. g., positions 1, 2, 18, and 19 (from the 5' end of a 19-nucleotide target) as described by Du et al. (2005) *Nucleic Acids Res.*, 33:1671-1677. Tolerated mismatches can be empirically determined in routine assays such as those described herein in the working Examples.

In some embodiments, the polynucleotides include additional nucleotides for reasons of stability or for convenience in cloning or synthesis. In one embodiment, the polynucleotide is a dsRNA including an RNA strand with a segment of at least 21 contiguous nucleotides of a sequence selected from the group consisting of SEQ ID NOs:860-1718 and 1722-1724 and further including an additional 5' G or an additional 3' C or both, adjacent to the segment. In another embodiment, the polynucleotide is a double-stranded RNA including additional nucleotides to form an overhang, for example, a dsRNA including 2 deoxyribonucleotides to form a 3' overhang.

Embedding Active Triggers in Neutral Sequence

In an embodiment, a bioactive trigger (i. e., a polynucleotide with a sequence corresponding to the target gene and which is responsible for an observed suppression of the target gene) is embedded in "neutral" sequence, e. g., inserted into additional nucleotides that have no sequence identity or complementarity to the target gene. Neutral sequence can be desirable, e. g., to increase the overall length of a polynucleotide. For example, it can be desirable for a polynucleotide to be of a particular size for reasons of stability, cost-effectiveness in manufacturing, or biological activity.

It has been reported that in another coleopteran species, *Diabrotica virgifera*, dsRNAs greater than or equal to approximately 60 base-pairs (bp) are required for biological activity in artificial diet bioassays; see Bolognesi et al. (2012) PLoS ONE 7(10): e47534. doi:10.1371/journal.pone.0047534. Thus, in one embodiment, a 21-base-pair dsRNA trigger corresponding to a target gene in Table 1 and found to provide control of an insect infestation is embedded in neutral sequence of an additional 39 base pairs, thus forming a polynucleotide of about 60 base pairs. In another embodiment, a single 21-base-pair trigger is found to be efficacious when embedded in larger sections of neutral sequence, e. g., where the total polynucleotide length is from about 60 to about 300 base pairs. In another embodiment, at least one segment of at least 21 contiguous nucleotides of a sequence selected from the group consisting of SEQ ID NOs:860-1718 and 1722-1724 is embedded in larger sections of neutral sequence to provide an efficacious trigger. In another embodiment, segments from multiple sequences selected from the group consisting of SEQ ID NOs:860-1718 and 1722-1724 are embedded in larger sections of neutral sequence to provide an efficacious trigger.

It is anticipated that the combination of certain recombinant RNAs disclosed herein (e. g., the dsRNA triggers including a sequence selected from the group consisting of SEQ ID NOs:860-1718 and 1722-1724, or active fragments of these triggers) with one or more non-polynucleotide pesticidal agents will result in a synergetic improvement in prevention or control of insect infestations, when compared to the effect obtained with the recombinant RNA alone or the non-polynucleotide pesticidal agent alone. Routine insect bioassays such as the bioassays described herein in the working Examples are useful for defining dose-responses for larval mortality or growth inhibition using combinations of the polynucleotides disclosed herein and one or more non-polynucleotide pesticidal agents (e. g., a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, and a *Bacillus sphaericus* insecticidal protein). One of skill in the art can test combinations of polynucleotides and non-polynucleotide pesticidal agents in routine bioassays to identify combinations of bioactives that are synergistic and desirable for use in protecting plants from insect infestations.

Example 5

This example illustrates non-limiting embodiments of methods of testing the efficacy of dsRNA triggers in flea beetles. More specifically this example illustrates a method including oral delivery of dsRNAs to flea beetles, resulting in stunting or mortality in the flea beetles.

*P. cruciferae* were collected from a canola field where no pesticides had been applied in the previous 3 months. Three dsRNAs (SEQ ID NOs:1169, 1193, and 1392) targeting *Phyllotreta* genes and one negative control dsRNA targeting GFP were tested on groups of 30 *P. cruciferae*. The dsRNAs were resuspended in water and applied to 6 millimeter leaf discs (55±6 milligrams each) at a discriminating dose of 50 nanograms dsRNA/milligram leaf tissue, which were fed to groups of 5 flea beetles. Leaf discs with freshly applied dsRNA were replaced every other day, and the number of surviving individuals was recorded over a 2-week period. A low non-specific mortality rate was observed in the negative-control insect groups (3 out of 30 insects dying over 2 weeks, or 10% non-specific mortality). Mortality was observed beginning at day 4 and continuing through the 2 week period. Specific mortality was observed for all dsRNA treatments (Table 2). Correcting for non-specific mortality (subtracting non-specific mortality rate of 3 insects per group for corrected N=27), the percent mortality observed at the end of the 2-week period was 85% (SEQ ID NO:1169), 0.70% (SEQ ID NO:1193), and 0.63% (SEQ ID NO:1392). These results demonstrated the efficacy of the dsRNA triggers in causing mortality in flea beetles when provided in the flea beetles' diet.

TABLE 2

| | Cumulative number of dead *P. cruciferae* (N = 30) | | | |
|---|---|---|---|---|
| Day | Negative control | SEQ ID NO: 1169 | SEQ ID NO: 1193 | SEQ ID NO: 1392 |
| 0 | 0 | 0 | 0 | 0 |
| 2 | 1 | 2 | 1 | 1 |
| 4 | 2 | 6 | 2 | 2 |
| 6 | 2 | 9 | 3 | 3 |
| 8 | 2 | 13 | 8 | 9 |
| 10 | 3 | 18 | 16 | 15 |
| 12 | 3 | 23 | 19 | 18 |
| 14 | 3 | 26 | 22 | 20 |

In a second series of experiments carried out in a similar manner, several dsRNA triggers were tested at a discriminating dose of 50 nanograms dsRNA/milligram leaf tissue on *P. cruciferae*; two lower doses (15 nanograms dsRNA/milligram leaf tissue and 2 nanograms dsRNA/milligram leaf tissue) were also tested. Ten beetles were tested at each dose. The negative control (five replicates) used was a dsRNA trigger targetting the bacterial gene uidA encoding beta-glucuronidase (NCBI accession number NC_000913.3). Leaf discs with freshly applied dsRNA were replaced every other day, and mortality was recorded over a 12 day period. The overall mortality rate for the negative controls was ~4% (likely due to handling injuries) over the 12-day observation period. The observed cumulative mortality (N=10) following 12 days exposure to the dsRNAs are provided in Table 3; the negative control mortality values are given as an average (N=5). Eight of the dsRNA triggers (indicated by a mortality rating of +++) caused 90-100% mortality at the highest dose and were still highly effective (80% or higher mortality) at the lowest dose tested. Some dsRNA triggers (indicated by a mortality rating of ++) induced mortality in a proportion of the insects at the highest dose, but were less effective at lower doses (<20% mortality).

TABLE 3

| | cumulative mortality (N = 10) | | | Mortality |
|---|---|---|---|---|
| Trigger SEQ ID NO: | 50 ng/mg | 15 ng/mg | 2 ng/mg | Rating* |
| 870 | 3 | 1 | 0 | – |
| 876 | 3 | 1 | 0 | – |
| 1156 | 2 | 0 | 0 | – |
| 1157 | 10 | 3 | 0 | – |
| 1158 | 2 | 0 | 0 | – |
| 1159 | 5 | 2 | 0 | – |
| 1160 | 2 | 0 | 0 | – |
| 1161 | 10 | 3 | 1 | – |
| 1163 | 4 | 4 | 2 | – |
| 1164 | 10 | 8 | 4 | ++ |
| 1165 | 8 | 7 | 5 | ++ |
| 1166 | 5 | 2 | 2 | – |
| 1167 | 6 | 2 | 0 | – |
| 1168 | 8 | 5 | 0 | – |
| 1169 | 10 | 10 | 8 | +++ |
| 1170 | 9 | 5 | 3 | – |
| 1171 | 10 | 10 | 6 | ++ |
| 1392 | 3 | 2 | 0 | – |
| 1393 | 6 | 1 | 0 | – |
| 1186 | 9 | 7 | 5 | – |
| 1394 | 9 | 9 | 5 | – |
| 1187 | 9 | 9 | 8 | +++ |
| 1193 | 10 | 10 | 9 | +++ |

TABLE 3-continued

| Trigger SEQ ID NO: | cumulative mortality (N = 10) | | | Mortality Rating* |
|---|---|---|---|---|
| | 50 ng/mg | 15 ng/mg | 2 ng/mg | |
| 1210 | 6 | 3 | 1 | – |
| 1219 | 8 | 3 | 2 | – |
| 1224 | 10 | 9 | 8 | +++ |
| 1234 | 10 | 7 | 6 | ++ |
| 1243 | 5 | 2 | 0 | – |
| 1258 | 9 | 4 | 2 | – |
| 1396 | 9 | 6 | 5 | ++ |
| 1397 | 6 | 3 | 0 | – |
| 1398 | 8 | 7 | 7 | ++ |
| 1399 | 10 | 10 | 8 | +++ |
| 1400 | 2 | 1 | 1 | – |
| 1403 | 9 | 6 | 6 | – |
| 1404 | 10 | 7 | 4 | – |
| 1405 | 6 | 6 | 2 | – |
| 1406 | 9 | 9 | 7 | +++ |
| 1407 | 10 | 9 | 8 | +++ |
| 1408 | 9 | 9 | 9 | +++ |
| negative control (GFP) | 0.6 | 0.6 | 0.4 | – |
| negative control (beta-glucuronidase) | 0.4 | 0.6 | 0.2 | – |
| negative control (water only) | 0.2 | 0.4 | 0.6 | – |

*+++ rating indicates high (>80%) mortalities for all three doses; ++ rating indicates high mortalities for the highest dose, and within 40 to 70% mortality with the lower two doses.

Other techniques for delivering these or similar dsRNA triggers are contemplated and include applying the dsRNA triggers directly to the insect surface (e. g. by spraying or dusting), or providing the dsRNA triggers to the insect in a diet or bait (e. g., in a bacterial or plant cell expressing a dsRNA trigger such as a hairpin form of a dsRNA trigger, or in an artificial bait containing the dsRNA). In an embodiment, a hairpin version of the Phyllotreta trigger with the sequence SEQ ID NO: 1169 is designed; this hairpin version is encoded by the DNA sequence SEQ ID NO:1722, which contains, in 5' to 3' order, anti-sense sequence (nucleotide positions 1-267), loop sequence (nucleotide positions 268-373) which does not contain matches to Phyllotreta sequences, and sense sequence (nucleotide positions 374-640). This DNA sequence is expressed as a single-stranded RNA transcript, wherein the anti-sense and sense regions anneal to form the double-stranded "stem" region of the hairpin. The construct is expressed in a bacterium, such as E. coli; the resulting dsRNA hairpin produced in the bacterium is provided to flea beetles as a crude or purified fermentation product, or in the form of the bacterial cells. Similar constructs are designed encoding dsRNAs having modified stem-loops, such as "stabilized anti-sense" or "stabilized sense" versions, which contain stabilized loops formed by an extended anti-sense or sense sequence, respectively, of trigger sequence corresponding to the intended target gene.

Example 6

This example discloses embodiments related to polynucleotide molecules having a nucleotide sequence containing specific modifications such as nucleotide substitutions. Embodiments of such modifications include modified dsRNA triggers that provide improved sequence discrimination between the intended target gene of the insect pest of interest, and genetic sequences of other, non-target species.

Selected dsRNA triggers identified in Table 1 were screened for unintended sequence matches to a sequence of at least 19 contiguous nucleotides identified in a non-target gene or a non-target organism (NTO, e. g., *Apis mellifera*, *Bombus impatiens* and *B. terrestris*; *Coleomegilla* spp.; *Danaus plexippus*; *Homo sapiens*; *Megachile rotundata*; *Mus musculus*; and *Brassica rapa*). Nucleotide changes are made in an original trigger sequence to eliminate undesirable sequence matches to a non-target gene or non-target organism. Examples of such modified trigger sequences are provided by SEQ ID NO:1723, which corresponds to SEQ ID NO:1393 (which targets the same flea beetle gene as does the trigger SEQ ID NO:1392), and SEQ ID NO:1724, which corresponds to SEQ ID NO:1169. These modified trigger sequences provide improved discrimination between the intended target species and non-target organisms.

Example 7

This example discloses embodiments related to polynucleotide molecules having a nucleotide sequence for silencing a target gene in more than one species. Embodiments include dsRNA sequences of at least 21 contiguous nucleotides identified as having 100% complementarity or identity to more than one species-specific target gene.

Table 4 provides a list of sequences, each at least 21 contiguous nucleotides in length and identified by the sequence's coordinates in a dsRNA trigger for one flea beetle species, wherein the identical sequence is also found in a dsRNA trigger for a different flea beetle species. These sequences are useful as triggers in the multiple species in which the sequence co-occurs. For example, the trigger having the sequence of SEQ ID NO:1186 (targetting a *Phyllotreta cruciferae* COPI alpha target gene, SEQ ID NO:327) contains five sequences of at least 21 contiguous nucleotides at positions 1-71, 88-116, 136-209, 238-266, and 274-296, all of which match a sequence in the triggers having the sequences of SEQ ID NOs:882 and 888 (targetting a *Phyllotreta atra* COPI alpha target genes, SEQ ID NOs:23 and 29, respectively); these five sequences are therefore useful in targeting a gene in the two *Phyllotreta* species.

TABLE 4

| QUERY Trigger | | | | QUERY Trigger | | | |
|---|---|---|---|---|---|---|---|
| SEQ ID NO: | start | end | SUBJECT Trigger SEQ ID NO: | SEQ ID NO: | start | end | SUBJECT Trigger Trigger SEQ ID NO: |
| 1186 | 1 | 71 | 882, 888 | 1333 | 329 | 351 | 1039-1043, 1045, 1594, 1597, 1598 |
| 1186 | 88 | 116 | 882, 888 | 1334 | 42 | 98 | 1039-1043, 1045, 1594, 1597, 1598 |
| 1186 | 136 | 209 | 882, 888 | 1334 | 109 | 185 | 1039-1043, 1045, 1594, 1597, 1598 |
| 1186 | 238 | 266 | 882, 888 | 1334 | 187 | 254 | 1039-1043, 1045, 1594, 1597, 1598 |

TABLE 4-continued

| QUERY Trigger SEQ ID NO: | start | end | SUBJECT Trigger SEQ ID NO: | QUERY Trigger SEQ ID NO: | start | end | SUBJECT Trigger Trigger SEQ ID NO: |
|---|---|---|---|---|---|---|---|
| 1186 | 274 | 296 | 882, 888 | 1334 | 271 | 302 | 1039-1043, 1045, 1594, 1597, 1598 |
| 1191 | 51 | 96 | 900-908, 910 | 1335 | 2 | 47 | 1039-1043, 1045, 1594, 1597, 1598 |
| 1191 | 137 | 177 | 900-908, 910 | 1335 | 49 | 116 | 1039-1043, 1045, 1594, 1597, 1598 |
| 1191 | 179 | 216 | 900-908, 910 | 1335 | 133 | 164 | 1039-1043, 1045, 1594, 1597, 1598 |
| 1191 | 218 | 255 | 900-908, 910 | 1335 | 229 | 251 | 1039-1043, 1045, 1594, 1597, 1598 |
| 1191 | 257 | 342 | 900-908, 910 | 1336 | 34 | 90 | 1039-1043, 1045, 1594, 1597, 1598 |
| 1192 | 2 | 25 | 900-908, 910 | 1336 | 101 | 177 | 1039-1043, 1045, 1594, 1597, 1598 |
| 1192 | 66 | 106 | 900-908, 910 | 1336 | 179 | 246 | 1039-1043, 1045, 1594, 1597, 1598 |
| 1192 | 108 | 145 | 900-908, 910 | 1336 | 263 | 294 | 1039-1043, 1045, 1594, 1597, 1598 |
| 1192 | 147 | 184 | 900-908, 910 | 1338 | 40 | 96 | 1039-1043, 1045, 1594, 1597, 1598 |
| 1192 | 186 | 271 | 900-908, 910 | 1338 | 107 | 183 | 1039-1043, 1045, 1594, 1597, 1598 |
| 1192 | 273 | 298 | 900-908, 910 | 1338 | 185 | 252 | 1039-1043, 1045, 1594, 1597, 1598 |
| 1192 | 300 | 330 | 900-908, 910 | 1338 | 269 | 300 | 1039-1043, 1045, 1594, 1597, 1598 |
| 1191 | 58 | 96 | 900-908, 910 | 1328 | 35 | 59 | 1039-1043, 1045, 1594, 1597, 1598 |
| 1192 | 300 | 336 | 900-908, 910 | 1331 | 60 | 84 | 1039-1043, 1045, 1594, 1597, 1598 |
| 1191 | 44 | 96 | 900-908, 910 | 1332 | 1 | 26 | 1039-1043, 1045, 1594, 1597, 1598 |
| 1191 | 179 | 200 | 900-908, 910 | 1333 | 36 | 60 | 1039-1043, 1045, 1594, 1597, 1598 |
| 1192 | 108 | 129 | 900-908, 910 | 1334 | 74 | 98 | 1039-1043, 1045, 1594, 1597, 1598 |
| 1191 | 218 | 242 | 900-908, 910 | 1336 | 66 | 90 | 1039-1043, 1045, 1594, 1597, 1598 |
| 1192 | 147 | 171 | 900-908, 910 | 1338 | 72 | 96 | 1039-1043, 1045, 1594, 1597, 1598 |
| 1191 | 257 | 277 | 900-908, 910 | 1331 | 1 | 26 | 1039-1043, 1045, 1594, 1597, 1598 |
| 1192 | 186 | 206 | 900-908, 910 | 1334 | 2 | 40 | 1039-1043, 1045, 1594, 1597, 1598 |
| 1191 | 257 | 334 | 900-908, 910 | 1336 | 2 | 32 | 1039-1043, 1045, 1594, 1597, 1598 |
| 1192 | 186 | 263 | 900-908, 910 | 1338 | 2 | 38 | 1039-1043, 1045, 1594, 1597, 1598 |
| 1191 | 257 | 320 | 900-908, 910 | 1328 | 36 | 59 | 1039-1043, 1045, 1594, 1597, 1598 |
| 1192 | 186 | 249 | 900-908, 910 | 1331 | 61 | 84 | 1039-1043, 1045, 1594, 1597, 1598 |
| 1193 | 15 | 101 | 911, 915, 916, 919 | 1332 | 3 | 26 | 1039-1043, 1045, 1594, 1597, 1598 |
| 1194 | 6 | 92 | 911, 915, 916, 919 | 1333 | 37 | 60 | 1039-1043, 1045, 1594, 1597, 1598 |
| 1195 | 2 | 107 | 911, 915, 916, 919 | 1334 | 75 | 98 | 1039-1043, 1045, 1594, 1597, 1598 |
| 1195 | 121 | 207 | 911, 915, 916, 919 | 1336 | 67 | 90 | 1039-1043, 1045, 1594, 1597, 1598 |
| 1196 | 2 | 122 | 911, 915, 916, 919 | 1338 | 73 | 96 | 1039-1043, 1045, 1594, 1597, 1598 |
| 1196 | 136 | 222 | 911, 915, 916, 919 | 1329 | 172 | 191 | 1039-1043 1045 |
| 1197 | 2 | 20 | 911, 915, 916, 919 | 1329 | 265 | 296 | 1039-1043 1045 |
| 1197 | 22 | 42 | 911, 915, 916, 919 | 1329 | 298 | 317 | 1039-1043 1045 |
| 1197 | 44 | 180 | 911, 915, 916, 919 | 1329 | 319 | 343 | 1039-1043 1045 |
| 1197 | 194 | 280 | 911, 915, 916, 919 | 1330 | 181 | 200 | 1039-1043 1045 |
| 1198 | 18 | 38 | 911, 915, 916, 919 | 1330 | 274 | 305 | 1039-1043 1045 |
| 1198 | 40 | 176 | 911, 915, 916, 919 | 1330 | 307 | 326 | 1039-1043 1045 |
| 1198 | 190 | 276 | 911, 915, 916, 919 | 1330 | 328 | 352 | 1039-1043 1045 |
| 1199 | 5 | 25 | 911, 915, 916, 919 | 1335 | 283 | 302 | 1039-1043, 1045, 1594, 1597, 1598 |
| 1199 | 27 | 163 | 911, 915, 916, 919 | 1337 | 1 | 19 | 1043, 1045 |
| 1199 | 177 | 263 | 911, 915, 916, 919 | 1337 | 93 | 124 | 1043, 1045 |
| 1200 | 16 | 152 | 911, 915, 916, 919 | 1337 | 126 | 145 | 1043, 1045 |

TABLE 4-continued

| QUERY Trigger SEQ ID NO: | start | end | SUBJECT Trigger SEQ ID NO: | QUERY Trigger SEQ ID NO: | start | end | SUBJECT Trigger SEQ ID NO: |
|---|---|---|---|---|---|---|---|
| 1200 | 166 | 252 | 911, 915, 916, 919 | 1337 | 147 | 171 | 1043, 1045 |
| 1201 | 19 | 105 | 911, 915, 916, 919 | 1329 | 319 | 352 | 1039-1043 1045 |
| 1202 | 2 | 119 | 911, 915, 916, 919 | 1337 | 147 | 180 | 1043, 1045 |
| 1202 | 133 | 219 | 911, 915, 916, 919 | 1386 | 2 | 38 | 1054-1057, 1060, 1496, 1498 |
| 1203 | 14 | 100 | 911, 915, 916, 919 | 1386 | 40 | 59 | 1054-1057, 1060, 1496, 1498 |
| 1193 | 123 | 189 | 911, 915, 916, 919 | 1386 | 70 | 95 | 1054-1057, 1060, 1496, 1498 |
| 1194 | 114 | 180 | 911, 915, 916, 919 | 1386 | 103 | 161 | 1054-1057, 1060, 1496, 1498 |
| 1195 | 229 | 295 | 911, 915, 916, 919 | 1386 | 196 | 262 | 1054-1057, 1060, 1496, 1498 |
| 1196 | 244 | 310 | 911, 915, 916, 919 | 1388 | 2 | 51 | 1054-1057, 1060, 1496, 1498 |
| 1197 | 302 | 350 | 911, 915, 916, 919 | 1388 | 53 | 72 | 1054-1057, 1060, 1496, 1498 |
| 1198 | 298 | 350 | 911, 915, 916, 919 | 1388 | 83 | 108 | 1054-1057, 1060, 1496, 1498 |
| 1199 | 285 | 352 | 911, 915, 916, 919 | 1388 | 116 | 174 | 1054-1057, 1060, 1496, 1498 |
| 1200 | 274 | 340 | 911, 915, 916, 919 | 1388 | 209 | 275 | 1054-1057, 1060, 1496, 1498 |
| 1201 | 127 | 193 | 911, 915, 916, 919 | 1390 | 88 | 119 | 1054-1057, 1060, 1492, 1496-1498 |
| 1202 | 241 | 307 | 911, 915, 916, 919 | 1390 | 145 | 194 | 1054-1057, 1060, 1492, 1496-1498 |
| 1203 | 122 | 188 | 911, 915, 916, 919 | 1390 | 196 | 215 | 1054-1057, 1060, 1492, 1496-1498 |
| 1193 | 123 | 196 | 911, 915, 916, 919 | 1390 | 226 | 251 | 1054-1057, 1060, 1492, 1496-1498 |
| 1193 | 198 | 230 | 911, 915, 916, 919 | 1390 | 259 | 317 | 1054-1057, 1060, 1492, 1496-1498 |
| 1194 | 114 | 187 | 911, 915, 916, 919 | 1391 | 19 | 50 | 1054-1057, 1060, 1492, 1496-1498 |
| 1194 | 189 | 221 | 911, 915, 916, 919 | 1391 | 76 | 125 | 1054-1057, 1060, 1492, 1496-1498 |
| 1195 | 229 | 302 | 911, 915, 916, 919 | 1391 | 127 | 146 | 1054-1057, 1060, 1492, 1496-1498 |
| 1195 | 304 | 336 | 911, 915, 916, 919 | 1391 | 157 | 182 | 1054-1057, 1060, 1492, 1496-1498 |
| 1196 | 1 | 122 | 911, 915, 916, 919 | 1391 | 190 | 248 | 1054-1057, 1060, 1492, 1496-1498 |
| 1196 | 244 | 317 | 911, 915, 916, 919 | 1391 | 283 | 349 | 1054-1057, 1060, 1492, 1496-1498 |
| 1196 | 319 | 351 | 911, 915, 916, 919 | 1384 | 20 | 39 | 1055, 1058, 1059, 1061-1063, 1500 |
| 1197 | 60 | 180 | 911, 915, 916, 919 | 1384 | 62 | 84 | 1055, 1058, 1059, 1061-1063, 1500 |
| 1198 | 56 | 176 | 911, 915, 916, 919 | 1384 | 134 | 204 | 1055, 1058, 1059, 1061-1063, 1500 |
| 1199 | 43 | 163 | 911, 915, 916, 919 | 1384 | 206 | 249 | 1055, 1058, 1059, 1061-1063, 1500 |
| 1199 | 285 | 351 | 911, 915, 916, 919 | 1384 | 251 | 270 | 1055, 1058, 1059, 1061-1063, 1500 |
| 1200 | 32 | 152 | 911, 915, 916, 919 | 1384 | 284 | 305 | 1055, 1058, 1059, 1061-1063, 1500 |
| 1200 | 274 | 347 | 911, 915, 916, 919 | 1385 | 21 | 40 | 1055, 1058, 1059, 1061-1063, 1500 |
| 1201 | 127 | 200 | 911, 915, 916, 919 | 1385 | 63 | 85 | 1055, 1058, 1059, 1061-1063, 1500 |
| 1201 | 202 | 234 | 911, 915, 916, 919 | 1385 | 135 | 205 | 1055, 1058, 1059, 1061-1063, 1500 |
| 1202 | 241 | 314 | 911, 915, 916, 919 | 1385 | 207 | 250 | 1055, 1058, 1059, 1061-1063, 1500 |
| 1202 | 316 | 348 | 911, 915, 916, 919 | 1385 | 252 | 271 | 1055, 1058, 1059, 1061-1063, 1500 |
| 1203 | 122 | 195 | 911, 915, 916, 919 | 1385 | 285 | 306 | 1055, 1058, 1059, 1061-1063, 1500 |
| 1203 | 197 | 229 | 911, 915, 916, 919 | 1387 | 2 | 21 | 1055, 1058, 1059, 1061-1063, 1500, 1057 |
| 1204 | 6 | 25 | 920, 921, 922, 923, 924 | 1387 | 23 | 42 | 1055, 1058, 1059, 1061-1063, 1500, 1057 |
| 1204 | 27 | 49 | 920, 921, 922, 923, 924 | 1387 | 56 | 77 | 1055, 1058, 1059, 1061-1063, 1500, 1057 |
| 1204 | 51 | 118 | 920, 921, 922, 923, 924 | 1389 | 1 | 55 | 1055, 1058, 1059, 1061-1063, 1500 |
| 1204 | 186 | 214 | 920, 921, 922, 923, 924 | 1389 | 57 | 100 | 1055, 1058, 1059, 1061-1063, 1500 |
| 1204 | 219 | 268 | 920, 921, 922, 923, 924 | 1389 | 102 | 121 | 1055, 1058, 1059, 1061-1063, 1500 |
| 1204 | 270 | 295 | 920, 921, 922, 923, 924 | 1389 | 135 | 156 | 1055, 1058, 1059, 1061-1063, 1500 |
| 1204 | 306 | 351 | 920, 921, 922, 923, 924 | 1386 | 196 | 255 | 1054-1057, 1060, 1496, 1498 |
| 1205 | 180 | 199 | 920, 921, 922, 923, 924 | 1388 | 209 | 268 | 1054-1057, 1060, 1496, 1498 |

TABLE 4-continued

| QUERY Trigger SEQ ID NO: | start | end | SUBJECT Trigger SEQ ID NO: | QUERY Trigger SEQ ID NO: | start | end | SUBJECT Trigger Trigger SEQ ID NO: |
|---|---|---|---|---|---|---|---|
| 1205 | 201 | 223 | 920, 921, 922, 923, 924 | 1391 | 283 | 342 | 1054-1057, 1060, 1492, 1496-1498 |
| 1205 | 225 | 292 | 920, 921, 922, 923, 924 | 1387 | 257 | 321 | 1055, 1058, 1059, 1061-1063, 1500, 1057 |
| 1206 | 10 | 29 | 920, 921, 922, 923, 924 | 1387 | 332 | 351 | 1055, 1058, 1059, 1061-1063, 1500, 1057 |
| 1206 | 31 | 53 | 920, 921, 922, 923, 924 | 1390 | 25 | 56 | 1054-1057, 1060, 1492, 1496-1498 |
| 1206 | 55 | 122 | 920, 921, 922, 923, 924 | 1384 | 284 | 321 | 1055, 1058, 1059, 1061-1063, 1500 |
| 1206 | 190 | 218 | 920, 921, 922, 923, 924 | 1385 | 285 | 322 | 1055, 1058, 1059, 1061-1063, 1500 |
| 1206 | 223 | 272 | 920, 921, 922, 923, 924 | 1387 | 56 | 93 | 1055, 1058, 1059, 1061-1063, 1500, 1057 |
| 1206 | 274 | 299 | 920, 921, 922, 923, 924 | 1389 | 135 | 172 | 1055, 1058, 1059, 1061-1063, 1500 |
| 1206 | 310 | 351 | 920, 921, 922, 923, 924 | 1386 | 196 | 332 | 1054-1057,1060, 1496, 1498 |
| 1207 | 11 | 33 | 920, 921, 922, 923, 924 | 1388 | 209 | 345 | 1054-1057, 1060, 1496, 1498 |
| 1207 | 35 | 102 | 920, 921, 922, 923, 924 | 1391 | 283 | 352 | 1054-1057, 1060, 1492, 1496-1498 |
| 1207 | 170 | 198 | 920, 921, 922, 923, 924 | 1384 | 323 | 348 | 1055, 1058, 1059, 1061-1063, 1500 |
| 1207 | 203 | 252 | 920, 921, 922, 923, 924 | 1385 | 324 | 349 | 1055, 1058, 1059, 1061-1063, 1500 |
| 1207 | 254 | 279 | 920, 921, 922, 923, 924 | 1387 | 95 | 120 | 1055, 1058, 1059, 1061-1063, 1500, 1057 |
| 1207 | 290 | 335 | 920, 921, 922, 923, 924 | 1387 | 128 | 153 | 1055, 1058, 1059, 1061-1063, 1500, 1057 |
| 1208 | 18 | 40 | 920, 921, 922, 923, 924 | 1387 | 161 | 186 | 1055, 1058, 1059, 1061-1063, 1500, 1057 |
| 1208 | 42 | 109 | 920, 921, 922, 923, 924 | 1387 | 191 | 210 | 1055, 1058, 1059, 1061-1063, 1500, 1057 |
| 1208 | 177 | 205 | 920, 921, 922, 923, 924 | 1389 | 174 | 199 | 1055, 1058, 1059, 1061-1063, 1500 |
| 1208 | 210 | 259 | 920, 921, 922, 923, 924 | 1389 | 207 | 232 | 1055, 1058, 1059, 1061-1063, 1500 |
| 1208 | 261 | 286 | 920, 921, 922, 923, 924 | 1389 | 240 | 265 | 1055, 1058, 1059, 1061-1063, 1500 |
| 1208 | 297 | 342 | 920, 921, 922, 923, 924 | 1389 | 270 | 289 | 1055, 1058, 1059, 1061- 063, 1500 |
| 1209 | 101 | 120 | 920, 921, 922, 923, 924 | 1283 | 177 | 208 | 1064-1070 |
| 1209 | 122 | 144 | 920, 921, 922, 923, 924 | 1284 | 130 | 161 | 1064-1070 |
| 1209 | 146 | 213 | 920, 921, 922, 923, 924 | 1284 | 301 | 351 | 1064-1070 |
| 1209 | 281 | 309 | 920, 921, 922, 923, 924 | 1286 | 210 | 241 | 1064-1070 |
| 1209 | 314 | 351 | 920, 921, 922, 923, 924 | 1287 | 126 | 157 | 1064-1070 |
| 1205 | 2 | 91 | 920, 921, 922, 923, 924 | 1287 | 297 | 351 | 1064-1070 |
| 1205 | 114 | 142 | 920, 921, 922, 923, 924 | 1288 | 326 | 351 | 1064-1070, 1071 |
| 1205 | 144 | 178 | 920, 921, 922, 923, 924 | 1289 | 41 | 72 | 1064-1070 |
| 1209 | 35 | 63 | 920, 921, 922, 923, 924 | 1289 | 212 | 288 | 1064-1070 |
| 1209 | 65 | 99 | 920, 921, 922, 923, 924 | 1289 | 320 | 351 | 1064-1070 |
| 1204 | 306 | 347 | 920, 921, 922, 923, 924 | 1290 | 178 | 209 | 1064-1070 |
| 1207 | 290 | 331 | 920, 921, 922, 923, 924 | 1291 | 228 | 259 | 1064-1070, 1071 |
| 1208 | 297 | 338 | 920, 921, 922, 923, 924 | 1292 | 43 | 74 | 1064-1070 |
| 1207 | 290 | 352 | 920, 921, 922, 923, 924 | 1292 | 214 | 290 | 1064-1070 |
| 1208 | 297 | 351 | 920, 921, 922, 923, 924 | 1292 | 322 | 351 | 1064-1070 |
| 1205 | 18 | 91 | 920, 921, 922, 923, 924 | 1293 | 330 | 351 | 1064-1070, 1071 |
| 1224 | 1 | 43 | 947-949, 951-956 | 1377 | 37 | 68 | 1064-1070 |
| 1224 | 57 | 95 | 947-949, 951-956 | 1377 | 208 | 284 | 1064-1070 |
| 1224 | 97 | 145 | 947-949, 951-956 | 1377 | 316 | 348 | 1064-1070 |
| 1224 | 147 | 175 | 947-949, 951-956 | 1289 | 212 | 274 | 1064-1070 |
| 1224 | 177 | 208 | 947-949, 951-956 | 1292 | 214 | 276 | 1064-1070 |
| 1224 | 210 | 262 | 947-949, 951-956 | 1377 | 208 | 270 | 1064-1070 |
| 1224 | 285 | 350 | 947-949, 951-956 | 1285 | 123 | 148 | 1067, 1069, 1071 |
| 1225 | 150 | 192 | 947, 949, 951-956 | 1288 | 107 | 132 | 1064-1070, 1071 |
| 1225 | 206 | 244 | 947, 949, 951-956 | 1291 | 9 | 34 | 1064-1070, 1071 |
| 1225 | 246 | 294 | 947, 949, 951-956 | 1293 | 111 | 136 | 1064-1070, 1071 |
| 1225 | 296 | 324 | 947, 949, 951-956 | 1287 | 297 | 347 | 1064-1070 |
| 1225 | 326 | 351 | 947, 949, 951-956 | 1289 | 212 | 262 | 1064-1070 |
| 1226 | 258 | 300 | 947, 949, 951-955 | 1292 | 214 | 264 | 1064-1070 |
| 1226 | 314 | 351 | 947, 949, 951-955 | 1377 | 208 | 258 | 1064-1070 |
| 1227 | 253 | 295 | 947, 949, 951-955 | 1287 | 297 | 352 | 1064-1070 |
| 1227 | 309 | 347 | 947, 949, 951-955 | 1289 | 212 | 266 | 1064-1070 |
| 1228 | 206 | 248 | 947, 949, 951-956 | 1292 | 214 | 268 | 1064-1070 |
| 1228 | 262 | 300 | 947, 949, 951-956 | 1377 | 208 | 262 | 1064-1070 |
| 1228 | 302 | 350 | 947, 949, 951-956 | 1285 | 18 | 61 | 1067, 1069, 1071 |

TABLE 4-continued

| QUERY Trigger | | | | QUERY Trigger | | | |
|---|---|---|---|---|---|---|---|
| SEQ ID NO: | start | end | SUBJECT Trigger SEQ ID NO: | SEQ ID NO: | start | end | SUBJECT Trigger Trigger SEQ ID NO: |
| 1229 | 171 | 213 | 947, 949, 951-956 | 1288 | 2 | 45 | 1064-1070, 1071 |
| 1229 | 227 | 265 | 947, 949, 951-956 | 1293 | 6 | 49 | 1064-1070, 1071 |
| 1229 | 267 | 315 | 947, 949, 951- 956 | 1357 | 1 | 40 | 1079-1082, 1152-1154, 1455, 1457, 1458 |
| 1229 | 317 | 345 | 947, 949, 951-956 | 1357 | 63 | 85 | 1079-1082, 1152-1154, 1455, 1457, 1458 |
| 1230 | 252 | 294 | 947, 949, 951-955 | 1357 | 102 | 157 | 1079-1082, 1152-1154, 1455, 1457, 1458 |
| 1230 | 308 | 346 | 947, 949, 951-955 | 1357 | 159 | 189 | 1079-1082, 1152-1154, 1455, 1457, 1458 |
| 1231 | 191 | 233 | 947, 949, 951-956 | 1357 | 191 | 322 | 1079-1082, 1152-1154, 1455, 1457, 1458 |
| 1231 | 247 | 285 | 947, 949, 951-956 | 1358 | 25 | 47 | 1079- 1082, 1152-1154, 1455, 1457, 1458 |
| 1231 | 287 | 335 | 947, 949, 951-956 | 1358 | 64 | 119 | 1079-1082, 1152-1154, 1455, 1457, 1458 |
| 1232 | 196 | 238 | 947, 949, 951-956 | 1358 | 121 | 151 | 1079-1082, 1152-1154, 1455, 1457, 1458 |
| 1232 | 252 | 290 | 947, 949, 951-956 | 1358 | 153 | 284 | 1079-1082, 1152-1154, 1455, 1457, 1458 |
| 1232 | 292 | 340 | 947, 949, 951-956 | 1359 | 31 | 53 | 1079-1082, 1152-1154, 1455, 1457, 1458 |
| 1233 | 209 | 251 | 947, 949, 951-956 | 1359 | 70 | 125 | 1079-1082, 1152-1154, 1455, 1457, 1458 |
| 1233 | 265 | 303 | 947, 949, 951-956 | 1359 | 127 | 157 | 1079-1082, 1152-1154, 1455, 1457, 1458 |
| 1233 | 305 | 351 | 947, 949, 951-956 | 1359 | 159 | 290 | 1079-1082, 1152-1154, 1455, 1457, 1458 |
| 1224 | 177 | 202 | 947-949, 951-956 | 1360 | 38 | 60 | 1079-1082, 1152-1154, 1455, 1457, 1458 |
| 1225 | 1 | 72 | 947, 949, 951-956 | 1360 | 77 | 132 | 1079-1082, 1152-1154, 1455, 1457, 1458 |
| 1225 | 74 | 135 | 947, 949, 951-956 | 1360 | 134 | 164 | 1079-1082, 1152-1154, 1455, 1457, 1458 |
| 1225 | 137 | 192 | 947, 949, 951-956 | 1360 | 166 | 297 | 1079-1082, 1152-1154, 1455, 1457, 1458 |
| 1226 | 110 | 180 | 947, 949, 951-955 | 1361 | 1 | 41 | 1079-1082, 1152-1154, 1455, 1457, 1458 |
| 1226 | 182 | 243 | 947, 949, 951-955 | 1361 | 64 | 86 | 1079-1082, 1152-1154, 1455, 1457, 1458 |
| 1226 | 245 | 300 | 947, 949, 951-955 | 1361 | 103 | 158 | 1079-1082, 1152-1154, 1455, 1457, 1458 |
| 1227 | 105 | 175 | 947, 949, 951-955 | 1361 | 160 | 190 | 1079-1082, 1152-1154, 1455, 1457, 1458 |
| 1227 | 177 | 238 | 947, 949, 951-955 | 1361 | 192 | 323 | 1079-1082, 1152-1154, 1455, 1457, 1458 |
| 1227 | 240 | 295 | 947, 949, 951-955 | 1362 | 31 | 53 | 1079-1082, 1152-1154, 1455, 1457, 1458 |
| 1228 | 58 | 128 | 947, 949, 951-956 | 1362 | 70 | 125 | 1079-1082, 1152-1154, 1455, 1457, 1458 |
| 1228 | 130 | 191 | 947, 949, 951-956 | 1362 | 127 | 157 | 1079-1082, 1152-1154, 1455, 1457, 1458 |
| 1228 | 193 | 248 | 947, 949, 951-956 | 1362 | 159 | 290 | 1079-1082, 1152-1154, 1455, 1457, 1458 |
| 1229 | 23 | 93 | 947, 949, 951-956 | 1363 | 33 | 55 | 1079-1082, 1152-1154, 1455, 1457, 1458 |
| 1229 | 95 | 156 | 947, 949, 951-956 | 1363 | 72 | 127 | 1079-1082, 1152-1154, 1455, 1457, 1458 |
| 1229 | 158 | 213 | 947, 949, 951-956 | 1363 | 129 | 159 | 1079-1082, 1152-1154, 1455, 1457, 1458 |
| 1230 | 104 | 174 | 947, 949, 951-955 | 1363 | 161 | 292 | 1079-1082, 1152-1154, 1455, 1457, 1458 |
| 1230 | 176 | 237 | 947, 949, 951-955 | 1364 | 4 | 59 | 1079-1082, 1152-1154, 1455, 1457, 1458 |
| 1230 | 239 | 294 | 947, 949, 951-955 | 1364 | 61 | 91 | 1079-1082, 1152-1154, 1455, 1457, 1458 |
| 1231 | 43 | 113 | 947, 949, 951-956 | 1364 | 93 | 224 | 1079-1082, 1152-1154, 1455, 1457, 1458 |
| 1231 | 115 | 176 | 947, 949, 951-956 | 1365 | 35 | 57 | 1079-1082, 1152-1154, 1455, 1457, 1458 |
| 1231 | 178 | 233 | 947, 949, 951-956 | 1365 | 74 | 129 | 1079-1082, 1152-1154, 1455, 1457, 1458 |
| 1232 | 48 | 118 | 947, 949, 951-956 | 1365 | 131 | 161 | 1079-1082, 1152-1154, 1455, 1457, 1458 |

TABLE 4-continued

| QUERY Trigger SEQ ID NO: | start | end | SUBJECT Trigger SEQ ID NO: | QUERY Trigger SEQ ID NO: | start | end | SUBJECT Trigger SEQ ID NO: |
|---|---|---|---|---|---|---|---|
| 1232 | 120 | 181 | 947, 949, 951-956 | 1365 | 163 | 294 | 1079-1082, 1152-1154, 1455, 1457, 1458 |
| 1232 | 183 | 238 | 947, 949, 951-956 | 1366 | 2 | 26 | 1079-1082, 1152-1154, 1455, 1457, 1458 |
| 1233 | 61 | 131 | 947, 949, 951-956 | 1366 | 28 | 58 | 1079-1082, 1152-1154, 1455, 1457, 1458 |
| 1233 | 133 | 194 | 947, 949, 951-956 | 1366 | 60 | 191 | 1079-1082, 1152-1154, 1455, 1457, 1458 |
| 1233 | 196 | 251 | 947, 949, 951-956 | 1367 | 2 | 116 | 1079, 1080, 1081, 1082, 1152, 1153, 1154 |
| 1224 | 227 | 262 | 947-949, 951-956 | 1358 | 322 | 345 | 1079-1082, 1152-1154, 1455, 1457, 1458 |
| 1224 | 57 | 94 | 947-949, 951-956 | 1359 | 328 | 350 | 1079-1082, 1152-1154, 1455, 1457, 1458 |
| 1225 | 2 | 72 | 947, 949, 951-956 | 1362 | 328 | 351 | 1079-1082, 1152-1154, 1455, 1457, 1458 |
| 1225 | 206 | 243 | 947, 949, 951-956 | 1363 | 330 | 352 | 1079-1082, 1152-1154, 1455, 1457, 1458 |
| 1226 | 1 | 96 | 947, 949, 951-955 | 1364 | 262 | 285 | 1079-1082, 1152-1154, 1455, 1457, 1458 |
| 1226 | 98 | 180 | 947, 949, 951-955 | 1365 | 332 | 351 | 1079-1082, 1152-1154, 1455, 1457, 1458 |
| 1227 | 2 | 91 | 947, 949, 951-955 | 1366 | 229 | 252 | 1079-1082, 1152-1154, 1455, 1457, 1458 |
| 1227 | 93 | 175 | 947, 949, 951-955 | 1367 | 154 | 177 | 1079-1082, 1152-1154 |
| 1227 | 309 | 346 | 947, 949, 951-955 | 1358 | 322 | 344 | 1079-1082, 1152-1154, 1455, 1457, 1458 |
| 1228 | 2 | 44 | 947, 949, 951-956 | 1362 | 328 | 350 | 1079-1082, 1152-1154, 1455, 1457, 1458 |
| 1228 | 46 | 128 | 947, 949, 951-956 | 1364 | 262 | 284 | 1079-1082, 1152-1154, 1455, 1457, 1458 |
| 1228 | 262 | 299 | 947, 949, 951-956 | 1366 | 229 | 251 | 1079-1082, 1152-1154, 1455, 1457, 1458 |
| 1229 | 11 | 93 | 947, 949, 951-956 | 1367 | 154 | 176 | 1079-1082, 1152-1154 |
| 1229 | 227 | 264 | 947, 949, 951-956 | 1368 | 126 | 145 | 1083, 1087 |
| 1230 | 2 | 90 | 947, 949, 951-955 | 1368 | 153 | 177 | 1083, 1087 |
| 1230 | 92 | 174 | 947, 949, 951-955 | 1368 | 186 | 208 | 1083, 1087 |
| 1230 | 308 | 345 | 947, 949, 951-955 | 1368 | 224 | 253 | 1083, 1087 |
| 1231 | 2 | 29 | 947, 949, 951-956 | 1369 | 161 | 180 | 1083, 1084, 1089 |
| 1231 | 31 | 113 | 947, 949, 951-956 | 1370 | 124 | 143 | 1083, 1087 |
| 1231 | 247 | 284 | 947, 949, 951-956 | 1370 | 151 | 175 | 1083, 1087 |
| 1232 | 2 | 34 | 947, 949, 951-956 | 1370 | 184 | 206 | 1083, 1087 |
| 1232 | 36 | 118 | 947, 949, 951-956 | 1370 | 222 | 251 | 1083, 1087 |
| 1232 | 252 | 289 | 947, 949, 951-956 | 1369 | 278 | 303 | 1083, 1084, 1089 |
| 1233 | 2 | 47 | 947, 949, 951-956 | 1369 | 182 | 201 | 1083, 1084, 1089 |
| 1233 | 49 | 131 | 947, 949, 951-956 | 1371 | 1 | 71 | 1093-1095, 1098, 1100-1103 |
| 1233 | 265 | 302 | 947, 949, 951-956 | 1371 | 82 | 122 | 1093-1095, 1098, 1100-1103 |
| 1226 | 7 | 96 | 947, 949, 951-955 | 1371 | 124 | 180 | 1093-1095, 1098, 110 -1103 |
| 1227 | 1 | 91 | 947, 949, 951-955 | 1371 | 182 | 244 | 1093-1095, 1098, 1100-1103 |
| 1226 | 8 | 96 | 947, 949, 951-955 | 1372 | 16 | 56 | 1093-1095, 1098, 1100-1103 |
| 1227 | 3 | 91 | 947, 949, 951-955 | 1372 | 58 | 114 | 1093-1095, 1098, 1100-1103 |
| 1230 | 1 | 90 | 947, 949, 951-955 | 1372 | 116 | 178 | 1093-1095, 1098, 1100-1103 |
| 1226 | 54 | 96 | 947, 949, 951-955 | 1373 | 2 | 61 | 1093-1095, 1098, 1100-1103 |
| 1227 | 49 | 91 | 947, 949, 951-955 | 1373 | 72 | 112 | 1093-1095, 1098, 1100-1103 |
| 1228 | 1 | 44 | 947, 949, 951-956 | 1373 | 114 | 170 | 1093-1095, 1098, 1100-1103 |
| 1230 | 48 | 90 | 947, 949, 951-955 | 1373 | 172 | 234 | 1093-1095, 1098, 1100-1103 |
| 1233 | 5 | 47 | 947, 949, 951-956 | 1374 | 1 | 68 | 1093-1095, 1098, 1100-1103 |
| 1224 | 125 | 145 | 947-949, 951-956 | 1374 | 79 | 119 | 1093-1095, 1098, 1100-1103 |
| 1225 | 274 | 294 | 947, 949, 951-956 | 1374 | 121 | 177 | 1093-1095, 1098, 1100-1103 |
| 1228 | 330 | 350 | 947, 949, 951-956 | 1374 | 179 | 241 | 1093-1095, 1098, 1100-1103 |
| 1229 | 295 | 315 | 947, 949, 951-956 | 1375 | 2 | 41 | 1093-1095, 1098, 1100-1103 |
| 1231 | 315 | 335 | 947, 949, 951-956 | 1375 | 52 | 92 | 1093-1095, 1098, 1100-1103 |
| 1232 | 320 | 340 | 947, 949, 951-956 | 1375 | 94 | 150 | 1093-1095, 1098, 1100-1103 |
| 1233 | 333 | 351 | 947, 949, 951-956 | 1375 | 152 | 214 | 1093-1095, 1098, 1100-1103 |
| 1234 | 50 | 135 | 960, 964 | 1376 | 7 | 47 | 1093-1095, 1098, 1100-1103 |
| 1234 | 149 | 168 | 960, 964 | 1376 | 49 | 105 | 1093-1095, 1098, 1100-1103 |
| 1234 | 170 | 350 | 960, 964 | 1376 | 107 | 169 | 1093-1095, 1098, 1100-1103 |
| 1235 | 175 | 260 | 960, 963, 964 | 1371 | 124 | 148 | 1093-1095, 1098, 1100-1103 |
| 1235 | 274 | 293 | 960, 963, 964 | 1372 | 58 | 82 | 1093-1095, 1098, 1100-1103 |
| 1235 | 295 | 351 | 960, 963, 964 | 1373 | 114 | 138 | 1093-1095, 1098, 1100-1103 |
| 1236 | 190 | 275 | 960, 963, 964 | 1374 | 121 | 145 | 1093-1095, 1098, 1100-1103 |
| 1236 | 289 | 308 | 960, 963, 964 | 1375 | 94 | 118 | 1093-1095, 1098, 1100-1103 |
| 1236 | 310 | 351 | 960, 963, 964 | 1376 | 49 | 73 | 1093-1095, 1098, 1100-1103 |
| 1237 | 269 | 350 | 960, 963, 964 | 1371 | 182 | 276 | 1093-1095, 1098, 1100-1103 |
| 1238 | 51 | 136 | 960, 964 | 1371 | 278 | 333 | 1093-1095, 1098, 1100-1103 |

TABLE 4-continued

| QUERY Trigger | | | | QUERY Trigger | | | |
|---|---|---|---|---|---|---|---|
| SEQ ID NO: | start | end | SUBJECT Trigger SEQ ID NO: | SEQ ID NO: | start | end | SUBJECT Trigger Trigger SEQ ID NO: |
| 1238 | 150 | 169 | 960, 964 | 1372 | 116 | 210 | 1093-1095, 1098, 1100-1103 |
| 1238 | 171 | 350 | 960, 964 | 1372 | 212 | 267 | 1093-1095, 1098, 1100-1103 |
| 1239 | 50 | 135 | 960, 964 | 1372 | 269 | 309 | 1093-1095, 1098, 1100-1103 |
| 1239 | 149 | 168 | 960, 964 | 1372 | 311 | 352 | 1093-1095, 1098, 1100-1103 |
| 1239 | 170 | 351 | 960, 964 | 1373 | 172 | 266 | 1093-1095, 1098, 1100-1103 |
| 1240 | 103 | 188 | 960, 963, 964 | 1373 | 268 | 323 | 1093-1095, 1098, 1100-1103 |
| 1240 | 202 | 221 | 960, 963, 964 | 1373 | 325 | 351 | 1093-1095, 1098, 1100-1103 |
| 1240 | 223 | 351 | 960, 963, 964 | 1374 | 179 | 273 | 1093-1095, 1098, 1100-1103 |
| 1241 | 269 | 351 | 960, 963, 964 | 1374 | 275 | 330 | 1093-1095, 1098, 1100-1103 |
| 1242 | 87 | 172 | 960, 963, 964 | 1374 | 332 | 351 | 1093-1095, 1098, 1100-1103 |
| 1242 | 186 | 205 | 960, 963, 964 | 1375 | 152 | 246 | 1093-1095, 1098, 1100-1103 |
| 1242 | 207 | 351 | 960, 963, 964 | 1375 | 248 | 303 | 1093-1095, 1098, 1100-1103 |
| 1235 | 2 | 23 | 960, 963, 964 | 1375 | 305 | 345 | 1093-1095, 1098, 1100-1103 |
| 1235 | 25 | 114 | 960, 963, 964 | 1376 | 107 | 201 | 1093-1095, 1098, 1100-1103 |
| 1236 | 2 | 38 | 960, 963, 964 | 1376 | 203 | 258 | 1093-1095, 1098, 1100-1103 |
| 1236 | 40 | 129 | 960, 963, 964 | 1376 | 260 | 300 | 1093-1095, 1098, 1100-1103 |
| 1237 | 2 | 39 | 960, 963, 964 | 1376 | 302 | 342 | 1093-1095, 1098, 1100-1103 |
| 1237 | 41 | 117 | 960, 963, 964 | 1371 | 278 | 303 | 1093-1095, 1098, 1100-1103 |
| 1237 | 119 | 208 | 960, 963, 964 | 1372 | 212 | 237 | 1093-1095, 1098, 1100-1103 |
| 1240 | 2 | 42 | 960, 963, 964 | 1373 | 268 | 293 | 1093-1095, 1098, 1100-1103 |
| 1241 | 2 | 39 | 960, 963, 964 | 1374 | 275 | 300 | 1093-1095, 1098, 1100-1103 |
| 1241 | 41 | 117 | 960, 963, 964 | 1375 | 248 | 273 | 1093-1095, 1098, 1100-1103 |
| 1241 | 119 | 208 | 960, 963, 964 | 1376 | 203 | 228 | 1093-1095, 1098, 1100-1103 |
| 1242 | 2 | 26 | 960, 963, 964 | 1371 | 124 | 155 | 1093-1095, 1098, 1100-1103 |
| 1234 | 38 | 135 | 960, 964 | 1372 | 58 | 89 | 1093-1095, 1098, 1100-1103 |
| 1234 | 170 | 211 | 960, 964 | 1373 | 114 | 145 | 1093-1095, 1098, 1100-1103 |
| 1235 | 25 | 136 | 960, 963, 964 | 1374 | 121 | 152 | 1093-1095, 1098, 1100-1103 |
| 1235 | 163 | 260 | 960, 963, 964 | 1375 | 94 | 125 | 1093-1095, 1098, 1100-1103 |
| 1235 | 295 | 336 | 960, 963, 964 | 1376 | 49 | 80 | 1093-1095, 1098, 1100-1103 |
| 1236 | 1 | 38 | 960, 963, 964 | 1371 | 182 | 241 | 1093-1095, 1098, 1100-1103 |
| 1236 | 40 | 151 | 960, 963, 964 | 1372 | 116 | 175 | 1093-1095, 1098, 1100-1103 |
| 1236 | 178 | 275 | 960, 963, 964 | 1373 | 172 | 231 | 1093-1095, 1098, 1100-1103 |
| 1237 | 81 | 117 | 960, 963, 964 | 1374 | 179 | 238 | 1093-1095, 1098, 1100-1103 |
| 1237 | 119 | 230 | 960, 963, 964 | 1375 | 152 | 211 | 1093-1095, 1098, 1100-1103 |
| 1237 | 257 | 350 | 960, 963, 964 | 1376 | 107 | 166 | 1093-1095, 1098, 1100-1103 |
| 1238 | 39 | 136 | 960, 964 | 1371 | 278 | 325 | 1093-1095, 1098, 1100-1103 |
| 1238 | 171 | 212 | 960, 964 | 1372 | 212 | 259 | 1093-1095, 1098, 1100-1103 |
| 1239 | 38 | 135 | 960, 964 | 1373 | 268 | 315 | 1093-1095, 1098, 1100-1103 |
| 1239 | 170 | 211 | 960, 964 | 1374 | 275 | 322 | 1093-1095, 1098, 1100-1103 |
| 1240 | 2 | 64 | 960, 963, 964 | 1375 | 248 | 295 | 1093-1095, 1098, 1100-1103 |
| 1240 | 91 | 188 | 960, 963, 964 | 1376 | 203 | 250 | 1093-1095, 1098, 1100-1103 |
| 1240 | 223 | 264 | 960, 963, 964 | 1309 | 1 | 69 | 1114, 1115 |
| 1241 | 81 | 117 | 960, 963, 964 | 1309 | 71 | 96 | 1114, 1115 |
| 1241 | 119 | 230 | 960, 963, 964 | 1309 | 98 | 144 | 1114, 1115 |
| 1241 | 257 | 351 | 960, 963, 964 | 1309 | 152 | 195 | 1114, 1115 |
| 1242 | 2 | 48 | 960, 963, 964 | 1309 | 197 | 237 | 1114, 1115 |
| 1242 | 75 | 172 | 960, 963, 964 | 1309 | 254 | 352 | 1114, 1115 |
| 1242 | 207 | 248 | 960, 963, 964 | 1310 | 25 | 92 | 1114, 1115 |
| 1243 | 118 | 158 | 965, 966, 968, 969 | 1310 | 94 | 119 | 1114, 1115 |
| 1243 | 283 | 304 | 965, 966, 968, 969 | 1310 | 121 | 167 | 1114, 1115 |
| 1243 | 310 | 348 | 965, 966, 968, 969 | 1310 | 175 | 218 | 1114, 1115 |
| 1244 | 165 | 205 | 965, 966, 968, 969 | 1310 | 220 | 260 | 1114, 1115 |
| 1244 | 330 | 351 | 965, 966, 968, 969 | 1310 | 277 | 351 | 1114, 1115 |
| 1246 | 205 | 245 | 965, 966, 967, 968, 969 | 1311 | 7 | 74 | 1114, 1115 |
| 1247 | 206 | 246 | 965, 966, 967, 968, 969 | 1311 | 76 | 101 | 1114, 1115 |
| 1248 | 163 | 203 | 965, 966, 968, 969 | 1311 | 103 | 149 | 1114, 1115 |
| 1248 | 328 | 349 | 965, 966, 968, 969 | 1311 | 157 | 200 | 1114, 1115 |
| 1245 | 1 | 20 | 967 | 1311 | 202 | 242 | 1114, 1115 |
| 1245 | 22 | 42 | 967 | 1311 | 259 | 351 | 1114, 1115 |
| 1245 | 104 | 135 | 967 | 1312 | 9 | 76 | 1114, 1115 |
| 1245 | 137 | 155 | 967 | 1312 | 78 | 103 | 1114, 1115 |
| 1245 | 187 | 209 | 967 | 1312 | 105 | 151 | 1114, 1115 |
| 1246 | 36 | 58 | 965, 966, 967, 968, 969 | 1312 | 159 | 202 | 1114, 1115 |
| 1247 | 37 | 59 | 965, 966, 967, 968, 969 | 1312 | 204 | 244 | 1114, 1115 |
| 1244 | 330 | 352 | 965, 966, 968, 969 | 1312 | 261 | 352 | 1114, 1115 |
| 1249 | 2 | 20 | 970, 973, 974, 978, 979 | 1309 | 2 | 69 | 1114, 1115 |
| 1250 | 5 | 84 | 969-971, 973-979 | 1309 | 254 | 327 | 1114, 1115 |
| 1250 | 86 | 270 | 969-971, 973-979 | 1310 | 22 | 92 | 1114, 1115 |
| 1250 | 278 | 306 | 969-971, 973-979 | 1310 | 277 | 350 | 1114, 1115 |
| 1250 | 326 | 351 | 969-971, 973-979 | 1311 | 4 | 74 | 1114, 1115 |
| 1251 | 2 | 52 | 969-971, 973-979 | 1311 | 259 | 332 | 1114, 1115 |
| 1251 | 54 | 238 | 969-971, 973-979 | 1312 | 6 | 76 | 1114, 1115 |
| 1251 | 246 | 274 | 969-971, 973-979 | 1312 | 261 | 334 | 1114, 1115 |
| 1251 | 294 | 322 | 969-971, 973-979 | 1315 | 56 | 87 | 1117, 1119-1125 |
| 1253 | 115 | 194 | 969-971, 973-979 | 1315 | 91 | 114 | 1117, 1119-1125 |

TABLE 4-continued

| QUERY Trigger SEQ ID NO: | start | end | SUBJECT Trigger SEQ ID NO: | QUERY Trigger SEQ ID NO: | start | end | SUBJECT Trigger Trigger SEQ ID NO: |
|---|---|---|---|---|---|---|---|
| 1253 | 196 | 351 | 969-971, 973-979 | 1315 | 116 | 144 | 1117, 1119-1125 |
| 1254 | 3 | 31 | 970, 971, 973, 974, 977-979 | 1315 | 146 | 171 | 1117, 1119-1125 |
| 1254 | 51 | 79 | 970, 971, 973, 974, 977-979 | 1315 | 185 | 225 | 1117, 1119-1125 |
| 1255 | 282 | 352 | 1629 | 1315 | 275 | 294 | 970, 971, 973-978, 1626, 1117, 1119-1125 |
| 1256 | 1 | 53 | 970, 971, 973-978 | 1315 | 317 | 342 | 1117, 1119-1125 |
| 1256 | 55 | 239 | 970, 971, 973-978 | 1316 | 22 | 45 | 1117, 1119-1125 |
| 1256 | 247 | 275 | 970, 971, 973-978 | 1316 | 47 | 75 | 1117, 1119-1125 |
| 1256 | 295 | 323 | 970, 971, 973-978 | 1316 | 77 | 102 | 1117, 1119-1125 |
| 1257 | 6 | 85 | 970, 971, 973-978 | 1316 | 116 | 156 | 1117, 1119-1125 |
| 1257 | 87 | 271 | 970, 971, 973-978 | 1316 | 206 | 225 | 1117, 1119-1125 |
| 1257 | 279 | 307 | 970, 971, 973-978 | 1316 | 248 | 273 | 1117, 1119-1125 |
| 1257 | 327 | 351 | 970, 971, 973-978 | 1316 | 275 | 317 | 1117, 1119-1125 |
| 1250 | 1 | 84 | 969-971, 973-979 | 1318 | 144 | 175 | 1117, 1119-1125 |
| 1250 | 326 | 352 | 969-971, 973-979 | 1318 | 179 | 202 | 1117, 1119-1125 |
| 1251 | 294 | 319 | 969-971, 973-979 | 1318 | 204 | 232 | 1117, 1119-1125 |
| 1253 | 112 | 194 | 969-971, 973-979 | 1318 | 234 | 259 | 1117, 1119-1125 |
| 1254 | 51 | 76 | 970, 971, 973, 974, 977-979 | 1318 | 273 | 313 | 1117, 1119-1125 |
| 1255 | 279 | 352 | 1629 | 1319 | 2 | 20 | 970, 971, 973-978, 1626, 1117, 1119-1125 |
| 1256 | 295 | 320 | 970, 971, 973-978 | 1319 | 24 | 47 | 1117, 1119-1125 |
| 1257 | 3 | 85 | 970, 971, 973-978 | 1319 | 49 | 77 | 1117, 1119-1125 |
| 1252 | 31 | 89 | 972 | 1319 | 79 | 104 | 1117, 1119-1125 |
| 1252 | 91 | 236 | 972 | 1319 | 118 | 158 | 1117, 1119-1125 |
| 1252 | 238 | 266 | 972 | 1319 | 208 | 227 | 1117, 1119-1125 |
| 1252 | 277 | 337 | 972 | 1319 | 250 | 275 | 1117, 1119-1125 |
| 1249 | 2 | 23 | 970, 973, 974, 978, 979 | 1319 | 277 | 319 | 1117, 1119-1125 |
| 1249 | 25 | 44 | 970, 973, 974, 978, 979 | 1313 | 17 | 81 | 1118, 1125 |
| 1250 | 34 | 84 | 969-971, 973-979 | 1313 | 92 | 117 | 1118, 1125 |
| 1251 | 1 | 52 | 969-971, 973-979 | 1313 | 137 | 204 | 1118, 1125 |
| 1251 | 294 | 325 | 969-971, 973-979 | 1313 | 215 | 240 | 1118, 1125 |
| 1251 | 327 | 346 | 969-971, 973-979 | 1313 | 242 | 291 | 1118, 1125 |
| 1253 | 144 | 194 | 969-971, 973-979 | 1313 | 293 | 329 | 1118, 1125 |
| 1254 | 51 | 82 | 970, 971, 973, 974, 977-979 | 1314 | 22 | 89 | 1118-1125 |
| 1254 | 84 | 103 | 970, 971, 973, 974, 977-979 | 1314 | 100 | 125 | 1118-1125 |
| 1255 | 311 | 352 | 1629 | 1314 | 127 | 176 | 970, 971, 973-978, 1626, 1118-1125 |
| 1256 | 3 | 53 | 970, 971, 973-978 | 1314 | 178 | 214 | 1118-1125 |
| 1256 | 295 | 326 | 970, 971, 973-978 | 1317 | 25 | 92 | 1118, 1120-1122, 1124, 1125 |
| 1256 | 328 | 347 | 970, 971, 973-978 | 1317 | 103 | 128 | 1118, 1120-1122, 1124, 1125 |
| 1257 | 35 | 85 | 970, 971, 973-978 | 1317 | 130 | 179 | 1118, 1120-1122, 1124, 1125 |
| 1250 | 47 | 84 | 969-971, 973-979 | 1317 | 181 | 217 | 1118, 1120-1122, 1124, 1125 |
| 1251 | 15 | 52 | 969-971, 973-979 | 1314 | 332 | 351 | 1118-1125 |
| 1253 | 157 | 194 | 969-971, 973-979 | 1315 | 27 | 51 | 1117, 1119-1125 |
| 1255 | 324 | 352 | 1629 | 1316 | 275 | 306 | 970, 971, 973-978, 1626, 1117, 1119-1125 |
| 1256 | 16 | 53 | 970, 971, 973-978 | 1318 | 115 | 139 | 1117, 1119-1125 |
| 1257 | 48 | 85 | 970, 971, 973-978 | 1319 | 277 | 308 | 1117, 1119-1125 |
| 1250 | 2 | 84 | 969-971, 973-979 | 1314 | 330 | 351 | 1118-1125 |
| 1250 | 86 | 241 | 969-971, 973-979 | 1315 | 25 | 51 | 1117, 1119-1125 |
| 1251 | 54 | 209 | 969-971, 973-979 | 1316 | 275 | 303 | 1117, 1119-1125 |
| 1253 | 1 | 68 | 969-971, 973-979 | 1317 | 333 | 351 | 1118, 1120-1122, 1124, 1125 |
| 1253 | 91 | 194 | 969-971, 973-979 | 1318 | 113 | 139 | 1117, 1119-1125 |
| 1253 | 196 | 352 | 969-971, 973-979 | 1319 | 277 | 305 | 1117, 1119-1125 |
| 1255 | 169 | 235 | 1629 | 1314 | 262 | 293 | 970, 971, 973-978, 1626, 1118-1125 |
| 1255 | 258 | 352 | 1629 | 1314 | 295 | 314 | 970, 971, 973-978, 1626, 1118-1125 |
| 1256 | 55 | 210 | 970, 971, 973-978 | 1314 | 316 | 351 | 1118-1125 |
| 1257 | 1 | 85 | 970, 971, 973-978 | 1315 | 11 | 51 | 1117, 1119-1125 |
| 1257 | 87 | 242 | 970, 971, 973-978 | 1317 | 265 | 296 | 1118, 1120-1122, 1124, 1125 |
| 1250 | 86 | 110 | 969-971, 973-979 | 1317 | 298 | 317 | 1118, 1120-1122, 1124, 1125 |
| 1251 | 54 | 78 | 969-971, 973-979 | 1317 | 319 | 351 | 1118, 1120-1122, 1124, 1125 |
| 1253 | 2 | 68 | 969-971, 973-979 | 1318 | 45 | 76 | 1117, 1119-1125 |
| 1253 | 196 | 220 | 969-971, 973-979 | 1318 | 78 | 97 | 1117, 1119-1125 |
| 1255 | 39 | 130 | 1629 | 1318 | 99 | 139 | 970, 971, 973-978, 1626, 1117, 1119-1125 |
| 1255 | 132 | 235 | 1629 | 1316 | 275 | 324 | 970, 971, 973-978, 1626, 1117, 1119-1125 |
| 1256 | 55 | 79 | 970, 971, 973-978 | 1319 | 277 | 326 | 1117, 1119-1125 |

TABLE 4-continued

| QUERY Trigger SEQ ID NO: | start | end | SUBJECT Trigger SEQ ID NO: | QUERY Trigger SEQ ID NO: | start | end | SUBJECT Trigger SEQ ID NO: |
|---|---|---|---|---|---|---|---|
| 1257 | 87 | 111 | 970, 971, 973-978 | 1299 | 50 | 96 | 1126-1131, 1651-1653 |
| 1250 | 326 | 350 | 969-971, 973-979 | 1300 | 2 | 43 | 1126-1131, 1651-1653 |
| 1251 | 294 | 318 | 969-971, 973-979 | 1300 | 66 | 112 | 1126-1131, 1651-1653 |
| 1253 | 110 | 194 | 969-971, 973-979 | 1300 | 123 | 154 | 1126-1131, 1651-1653 |
| 1254 | 51 | 75 | 970, 971, 973, 974, 977-979 | 1300 | 183 | 211 | 1126-1131, 1651-1653 |
| 1255 | 277 | 352 | 1629 | 1300 | 213 | 232 | 970, 971, 973-978, 1626, 1126-1131, 1651-1653 |
| 1256 | 295 | 319 | 970, 971, 973-978 | 1300 | 264 | 310 | 1126-1131, 1651-1653 |
| 1257 | 327 | 352 | 970, 971, 973-978 | 1301 | 1 | 35 | 1126-1131 |
| 1250 | 32 | 84 | 969 - 971, 973-979 | 1301 | 37 | 84 | 1126-1131 |
| 1253 | 142 | 194 | 969 - 971, 973-979 | 1301 | 107 | 153 | 1126-1131 |
| 1255 | 309 | 352 | 1629 | 1301 | 164 | 195 | 970, 971, 973-978, 1626, 1126-1131 |
| 1257 | 33 | 85 | 970, 971, 973-978 | 1301 | 224 | 252 | 1126-1131 |
| 1249 | 46 | 68 | 970, 973, 974, 978, 979 | 1301 | 254 | 273 | 1126-1131 |
| 1250 | 61 | 84 | 969-971, 973-979 | 1301 | 305 | 351 | 1126-1131 |
| 1251 | 29 | 52 | 969-971, 973-979 | 1302 | 26 | 54 | 1126-1131, 1651-1653 |
| 1253 | 171 | 194 | 969-971, 973-979 | 1302 | 56 | 75 | 1126-1131, 1651-1653 |
| 1254 | 105 | 127 | 970, 971, 973, 974, 977-979 | 1302 | 107 | 153 | 1126-1131, 1651-1653 |
| 1256 | 30 | 53 | 970, 971, 973-978 | 1303 | 11 | 39 | 1126-1131, 1651-1653 |
| 1257 | 62 | 85 | 970, 971, 973-978 | 1303 | 41 | 60 | 1126-1131, 1651-1653 |
| 1259 | 192 | 226 | 999-1004 | 1303 | 92 | 138 | 1126-1131, 1651-1653 |
| 1259 | 249 | 298 | 999-1004 | 1299 | 50 | 114 | 1126-1131, 1651-1653 |
| 1259 | 321 | 352 | 999-1004 | 1299 | 131 | 162 | 1126-1131, 1651-1653 |
| 1260 | 190 | 224 | 999-1004 | 1299 | 215 | 236 | 1126-1131, 1651-1653 |
| 1260 | 247 | 296 | 999-1004 | 1299 | 248 | 270 | 1126-1131, 1651-1653 |
| 1260 | 319 | 351 | 999-1004 | 1299 | 272 | 309 | 1126-1131, 1651-1653 |
| 1261 | 99 | 133 | 999-1004 | 1300 | 264 | 328 | 1126-1131, 1651-1653 |
| 1261 | 156 | 205 | 999-1004 | 1302 | 107 | 171 | 1126-1131, 1651-1653 |
| 1261 | 228 | 289 | 999-1004 | 1302 | 188 | 219 | 1126-1131, 1651-1653 |
| 1261 | 300 | 334 | 999-1004 | 1302 | 272 | 293 | 1126-1131, 1651-1653 |
| 1262 | 82 | 116 | 999-1004 | 1302 | 305 | 327 | 1126-1131, 1651-1653 |
| 1262 | 139 | 188 | 999-1004 | 1302 | 329 | 351 | 1126-1131, 1651-1653 |
| 1262 | 211 | 272 | 999-1004 | 1303 | 92 | 156 | 1126-1131, 1651-1653 |
| 1262 | 283 | 317 | 999-1004 | 1303 | 173 | 204 | 1126-1131, 1651-1653 |
| 1262 | 319 | 350 | 999-1004 | 1303 | 257 | 278 | 1126-1131, 1651-1653 |
| 1263 | 324 | 351 | 999-1004 | 1303 | 290 | 312 | 1126-1131, 1651-1653 |
| 1264 | 191 | 225 | 999-1004 | 1303 | 314 | 351 | 1126-1131, 1651-1653 |
| 1264 | 248 | 297 | 999-1004 | 1299 | 272 | 352 | 1126-1131, 1651-1653 |
| 1264 | 320 | 351 | 999-1004 | 1299 | 272 | 344 | 1126-1131, 1651-1653 |
| 1265 | 98 | 132 | 999-1004 | 1299 | 272 | 318 | 1126-1131, 1651-1653 |
| 1265 | 155 | 204 | 999-1004 | 1299 | 272 | 310 | 1126-1131, 1651-1653 |
| 1265 | 227 | 288 | 999-1004 | 1304 | 2 | 25 | 1132, 1134, 1135, 1136 |
| 1265 | 299 | 333 | 999-1004 | 1304 | 36 | 169 | 1132, 1134, 1135, 1136 |
| 1259 | 95 | 145 | 999-1004 | 1304 | 186 | 214 | 1132, 1134, 1135, 1136 |
| 1259 | 165 | 226 | 999-1004 | 1304 | 231 | 250 | 1132, 1134, 1135, 1136 |
| 1260 | 93 | 143 | 999-1004 | 1304 | 264 | 307 | 1132, 1134, 1135, 1136 |
| 1260 | 163 | 224 | 999-1004 | 1306 | 2 | 70 | 1132, 1134, 1135, 1136 |
| 1261 | 1 | 52 | 999-1004 | 1306 | 87 | 115 | 1132, 1134, 1135, 1136 |
| 1261 | 72 | 133 | 999-1004 | 1306 | 132 | 151 | 1132, 1134, 1135, 1136 |
| 1262 | 1 | 35 | 999-1004 | 1306 | 165 | 208 | 1132, 1134, 1135, 1136 |
| 1262 | 55 | 116 | 999-1004 | 1307 | 1 | 27 | 1132, 1134, 1135, 1136 |
| 1263 | 227 | 277 | 999-1004 | 1307 | 29 | 69 | 1132, 1134, 1135, 1136 |
| 1263 | 297 | 351 | 999-1004 | 1307 | 80 | 213 | 1132, 1134, 1135, 1136 |
| 1264 | 94 | 144 | 999-1004 | 1307 | 230 | 258 | 1132, 1134, 1135, 1136 |
| 1264 | 164 | 225 | 999-1004 | 1307 | 275 | 294 | 1132, 1134, 1135, 1136 |
| 1265 | 2 | 51 | 999-1004 | 1307 | 308 | 351 | 1132, 1134, 1135, 1136 |
| 1265 | 71 | 132 | 999-1004 | 1308 | 2 | 33 | 1132, 1134, 1135, 1136 |
| 1259 | 15 | 40 | 999-1004 | 1308 | 44 | 177 | 1132, 1134, 1135, 1136 |
| 1259 | 42 | 64 | 999-1004 | 1308 | 194 | 222 | 1132, 1134, 1135, 1136 |
| 1259 | 66 | 88 | 999-1004 | 1308 | 239 | 258 | 1132, 1134, 1135, 1136 |
| 1259 | 90 | 145 | 999-1004 | 1308 | 272 | 315 | 1132, 1134, 1135, 1136 |
| 1259 | 165 | 219 | 999-1004 | 1347 | 2 | 28 | 1132, 1134, 1135, 1136 |
| 1260 | 13 | 38 | 999-1004 | 1347 | 39 | 172 | 1132, 1134, 1135, 1136 |
| 1260 | 40 | 62 | 999-1004 | 1347 | 189 | 217 | 1132, 1134, 1135, 1136 |
| 1260 | 64 | 86 | 999-1004 | 1347 | 234 | 253 | 1132, 1134, 1135, 1136 |
| 1260 | 88 | 143 | 999-1004 | 1347 | 267 | 310 | 1132, 1134, 1135, 1136 |
| 1260 | 163 | 217 | 999-1004 | 1305 | 1 | 133 | 1133, 1137, 1138, 1580, 1581, 1583 |
| 1261 | 2 | 52 | 999-1004 | 1305 | 135 | 154 | 1133, 1137, 1138, 1580, 1581, 1583 |
| 1261 | 72 | 126 | 999-1004 | 1305 | 156 | 178 | 1133, 1137, 1138, 1580, 1581, 1583 |

TABLE 4-continued

| QUERY Trigger SEQ ID NO: | start | end | SUBJECT Trigger SEQ ID NO: | QUERY Trigger SEQ ID NO: | start | end | SUBJECT Trigger Trigger SEQ ID NO: |
|---|---|---|---|---|---|---|---|
| 1262 | 55 | 109 | 999-1004 | 1305 | 195 | 280 | 1133, 1137, 1138, 1580, 1581, 1583 |
| 1263 | 1 | 60 | 999-1004 | 1305 | 330 | 351 | 1133, 1137, 1138, 1580, 1581, 1583 |
| 1263 | 105 | 127 | 999-1004 | 1344 | 13 | 35 | 1133, 1137, 1138, 1580, 1581, 1583 |
| 1263 | 147 | 172 | 999-1004 | 1344 | 52 | 137 | 1133, 1137, 1138, 1580, 1581, 1583 |
| 1263 | 174 | 196 | 999-1004 | 1344 | 187 | 208 | 1133, 1137, 1138, 1580, 1581, 1583 |
| 1263 | 198 | 220 | 999-1004 | 1345 | 50 | 181 | 1133, 1137, 1138, 1580, 1581, 1583 |
| 1263 | 222 | 277 | 999-1004 | 1345 | 183 | 202 | 1133, 1137, 1138, 1580, 1581, 1583 |
| 1263 | 297 | 352 | 999-1004 | 1345 | 204 | 226 | 1133, 1137, 1138, 1580, 1581, 1583 |
| 1264 | 14 | 39 | 999-1004 | 1345 | 243 | 328 | 1133, 1137, 1138, 1580, 1581, 1583 |
| 1264 | 41 | 63 | 999-1004 | 1346 | 2 | 81 | 1133, 1137, 1138 |
| 1264 | 65 | 87 | 999-1004 | 1346 | 131 | 152 | 1133, 1137, 1138 |
| 1264 | 89 | 144 | 999-1004 | 1304 | 1 | 25 | 1132, 1134, 1135, 1136 |
| 1264 | 164 | 218 | 999-1004 | 1304 | 264 | 334 | 1132, 1134, 1135, 1136 |
| 1265 | 71 | 125 | 999-1004 | 1306 | 165 | 235 | 1132, 1134, 1135, 1136 |
| 1259 | 190 | 226 | 999-1004 | 1307 | 46 | 69 | 1132, 1134, 1135, 1136 |
| 1260 | 188 | 224 | 999-1004 | 1308 | 10 | 33 | 1132, 1134, 1135, 1136 |
| 1261 | 97 | 133 | 999-1004 | 1308 | 272 | 342 | 1132, 1134, 1135, 1136 |
| 1262 | 80 | 116 | 999-1004 | 1347 | 5 | 28 | 1132, 1134, 1135, 1136 |
| 1263 | 322 | 351 | 999-1004 | 1347 | 267 | 337 | 1132, 1134, 1135, 1136 |
| 1264 | 189 | 225 | 999-1004 | 1304 | 101 | 169 | 1132, 1134, 1135, 1136 |
| 1265 | 96 | 132 | 999-1004 | 1306 | 1 | 70 | 1132, 1134, 1135, 1136 |
| 1259 | 96 | 145 | 999-1004 | 1306 | 237 | 310 | 1132, 1134, 1135, 1136 |
| 1260 | 94 | 143 | 999-1004 | 1306 | 312 | 352 | 1132, 1134, 1135, 1136 |
| 1261 | 3 | 52 | 999-1004 | 1307 | 145 | 213 | 1132, 1134, 1135, 1136 |
| 1263 | 228 | 277 | 999-1004 | 1308 | 109 | 177 | 1132, 1134, 1135, 1136 |
| 1264 | 95 | 144 | 999-1004 | 1347 | 104 | 172 | 1132, 1134, 1135, 1136 |
| 1265 | 1 | 51 | 999-1004 | 1307 | 38 | 69 | 1132, 1134, 1135, 1136 |
| 1259 | 165 | 218 | 999-1004 | 1308 | 1 | 33 | 1132, 1134, 1135, 1136 |
| 1260 | 163 | 216 | 999-1004 | 1344 | 187 | 239 | 1133, 1137, 1138, 1580, 1581, 1583 |
| 1261 | 72 | 125 | 999-1004 | 1344 | 241 | 272 | 1133, 1137, 1138, 1580, 1581, 1583 |
| 1262 | 55 | 108 | 999-1004 | 1344 | 286 | 308 | 1133, 1137, 1138, 1580, 1581, 1583 |
| 1263 | 2 | 60 | 999-1004 | 1344 | 310 | 329 | 1133, 1137, 1138, 1580, 1581, 1583 |
| 1263 | 297 | 350 | 999-1004 | 1346 | 131 | 183 | 1133, 1137, 1138 |
| 1264 | 164 | 217 | 999-1004 | 1346 | 185 | 216 | 1133, 1137, 1138 |
| 1265 | 71 | 124 | 999-1004 | 1346 | 230 | 252 | 1133, 1137, 1138 |
| 1266 | 2 | 39 | 1016-1023 | 1346 | 254 | 273 | 1133, 1137, 1138 |
| 1266 | 41 | 87 | 1016-1023 | 1305 | 227 | 280 | 1133, 1137, 1138, 1580, 1581, 1583 |
| 1266 | 89 | 129 | 1016-1023 | 1344 | 84 | 137 | 1133, 1137, 1138, 1580, 1581, 1583 |
| 1267 | 2 | 74 | 1016-1023 | 1345 | 275 | 328 | 1133, 1137, 1138, 1580, 1581, 1583 |
| 1267 | 76 | 122 | 1016-1023 | 1346 | 28 | 81 | 1133, 1137, 1138 |
| 1267 | 124 | 164 | 1016-1023 | 1346 | 290 | 351 | 1133, 1137, 1138 |
| 1268 | 2 | 53 | 1016-1023 | 1348 | 44 | 66 | 1139, 1140, 1141, 1142 |
| 1268 | 55 | 101 | 1016-1023 | 1348 | 104 | 129 | 1139, 1140, 1141, 1142 |
| 1268 | 103 | 143 | 1016-1023 | 1348 | 131 | 156 | 1139, 1140, 1141, 1142 |
| 1269 | 2 | 72 | 1016-1023 | 1348 | 158 | 195 | 1139, 1140, 1141, 1142 |
| 1269 | 74 | 120 | 1016-1023 | 1348 | 167 | 189 | 1139, 1140, 1141, 1142 |
| 1269 | 122 | 162 | 1016-1023 | 1348 | 197 | 237 | 1139, 1140, 1141, 1142 |
| 1270 | 2 | 107 | 1016-1023 | 1348 | 215 | 234 | 1139, 1140, 1141, 1142 |
| 1270 | 109 | 155 | 1016-1023 | 1348 | 4 | 49 | 1139, 1140, 1141, 1142 |
| 1270 | 157 | 197 | 1016-1023 | 1348 | 4 | 74 | 1139, 1140, 1141, 1142 |
| 1271 | 2 | 62 | 1016-1023 | 1348 | 4 | 85 | 1139, 1140, 1141, 1142 |
| 1271 | 64 | 110 | 1016-1023 | 1349 | 19 | 90 | 1143 |
| 1271 | 112 | 152 | 1016-1023 | 1349 | 146 | 207 | 1143 |
| 1266 | 131 | 177 | 1016-1023 | 1349 | 209 | 256 | 1143 |
| 1266 | 179 | 207 | 1016-1023 | 1350 | 32 | 51 | 1144-1151, 1703 |
| 1266 | 209 | 243 | 1016-1023 | 1350 | 71 | 90 | 1144-1151, 1703 |
| 1267 | 166 | 212 | 1016-1023 | 1351 | 118 | 137 | 1144-1151 |
| 1267 | 214 | 242 | 1016-1023 | 1351 | 157 | 176 | 1144-1151 |
| 1267 | 244 | 278 | 1016-1023 | 1353 | 81 | 100 | 1144-1151 |

TABLE 4-continued

| QUERY Trigger | | | | QUERY Trigger | | | |
|---|---|---|---|---|---|---|---|
| SEQ ID NO: | start | end | SUBJECT Trigger SEQ ID NO: | SEQ ID NO: | start | end | SUBJECT Trigger Trigger SEQ ID NO: |
| 1268 | 145 | 191 | 1016-1023 | 1353 | 120 | 139 | 1144-1151 |
| 1268 | 193 | 221 | 1016-1023 | 1354 | 1 | 42 | 1144-1151 |
| 1268 | 223 | 257 | 1016-1023 | 1354 | 218 | 237 | 1144-1151 |
| 1269 | 164 | 210 | 1016-1023 | 1354 | 257 | 276 | 1144-1151 |
| 1269 | 212 | 240 | 1016-1023 | 1356 | 43 | 62 | 1144-1151 |
| 1269 | 242 | 276 | 1016-1023 | 1356 | 82 | 101 | 1144-1151 |
| 1270 | 199 | 245 | 1016-1023 | 1350 | 176 | 201 | 1144-1151, 1703 |
| 1270 | 247 | 275 | 1016-1023 | 1350 | 209 | 231 | 1144-1151, 1703 |
| 1270 | 277 | 311 | 1016-1023 | 1350 | 236 | 267 | 1144-1151, 1703 |
| 1271 | 154 | 200 | 1016-1023 | 1351 | 262 | 287 | 1144-1151 |
| 1271 | 202 | 230 | 1016-1023 | 1351 | 295 | 317 | 1144-1151 |
| 1271 | 232 | 266 | 1016-1023 | 1351 | 322 | 351 | 1144-1151 |
| 1266 | 209 | 294 | 1016-1023 | 1353 | 225 | 250 | 1144-1151 |
| 1266 | 296 | 316 | 1016-1023 | 1353 | 258 | 280 | 1144-1151 |
| 1267 | 1 | 74 | 1016-1023 | 1353 | 285 | 316 | 1144-1151 |
| 1267 | 244 | 329 | 1016-1023 | 1356 | 187 | 212 | 1144-1151 |
| 1267 | 331 | 351 | 1016-1023 | 1356 | 220 | 242 | 1144-1151 |
| 1268 | 223 | 308 | 1016-1023 | 1356 | 247 | 278 | 1144-1151 |
| 1268 | 310 | 330 | 1016-1023 | 1350 | 236 | 265 | 1144-1151, 1703 |
| 1269 | 242 | 327 | 1016-1023 | 1351 | 322 | 352 | 1144-1151 |
| 1269 | 329 | 349 | 1016-1023 | 1353 | 285 | 314 | 1144-1151 |
| 1270 | 35 | 107 | 1016-1023 | 1356 | 247 | 276 | 1144-1151 |
| 1270 | 277 | 351 | 1016-1023 | 1350 | 287 | 306 | 1144-1151, 1703 |
| 1271 | 232 | 317 | 1016-1023 | 1350 | 323 | 348 | 1144-1151, 1703 |
| 1271 | 319 | 339 | 1016-1023 | 1352 | 2 | 21 | 1147, 1150, 1151, 1703 |
| 1266 | 296 | 318 | 1016-1023 | 1352 | 38 | 63 | 1147, 1150, 1151, 1703 |
| 1267 | 4 | 74 | 1016-1023 | 1355 | 5 | 24 | 1147, 1150, 1151, 1703 |
| 1268 | 310 | 332 | 1016-1023 | 1355 | 41 | 66 | 1147, 1150, 1151, 1703 |
| 1269 | 1 | 72 | 1016-1023 | 1356 | 298 | 317 | 1144-1151 |
| 1269 | 329 | 351 | 1016-1023 | 1358 | 322 | 351 | 1079-1082, 1152-1154, 1455, 1457, 1458 |
| 1270 | 37 | 107 | 1016-1023 | 1364 | 262 | 291 | 1079-1082, 1152-1154, 1455, 1457, 1458 |
| 1271 | 319 | 341 | 1016-1023 | 1366 | 229 | 258 | 1079-1082, 1152-1154, 1455, 1457, 1458 |
| 1266 | 131 | 157 | 1016-1023 | 1367 | 154 | 183 | 1079-1082, 1152-1154 |
| 1267 | 166 | 192 | 1016-1023 | 1361 | 2 | 41 | 1079-1082, 1152-1154, 1455, 1457, 1458 |
| 1268 | 145 | 171 | 1016-1023 | 1210 | 1 | 35 | 1431 |
| 1269 | 164 | 190 | 1016-1023 | 1211 | 30 | 63 | 1431 |
| 1270 | 199 | 225 | 1016-1023 | 1213 | 15 | 48 | 1431 |
| 1271 | 154 | 180 | 1016-1023 | 1217 | 19 | 52 | 1431 |
| 1295 | 113 | 168 | 1026, 1027, 1024 | 1357 | 162 | 200 | 1079-1082, 1152-1154, 1455, 1457, 1458 |
| 1295 | 170 | 201 | 1026, 1027, 1024 | 1358 | 124 | 162 | 1079-1082, 1152-1154, 1455, 1457, 1458 |
| 1295 | 203 | 233 | 1026, 1027, 1024 | 1359 | 130 | 168 | 1079-1082, 1152-1154, 1455, 1457, 1458 |
| 1295 | 236 | 258 | 1026, 1027, 1024 | 1360 | 137 | 175 | 1079-1082, 1152-1154, 1455, 1457, 1458 |
| 1297 | 128 | 183 | 1026, 1027, 1024 | 1361 | 163 | 201 | 1079-1082, 1152-1154, 1455, 1457, 1458 |
| 1297 | 185 | 216 | 1026, 1027, 1024 | 1362 | 130 | 168 | 1079-1082, 1152-1154, 1455, 1457, 1458 |
| 1297 | 218 | 248 | 1026, 1027, 1024 | 1363 | 132 | 170 | 1079-1082, 1152-1154, 1455, 1457, 1458 |
| 1296 | 1 | 44 | 1025, 1028, 1029, 1515-1518, 1520 | 1364 | 64 | 102 | 1079-1082, 1152-1154, 1455, 1457, 1458 |
| 1298 | 7 | 57 | 1025, 1028, 1029 | 1365 | 134 | 172 | 1079-1082, 1152-1154, 1455, 1457, 1458 |
| 1298 | 59 | 96 | 1025, 1028, 1029 | 1366 | 31 | 69 | 1079-1082, 1152-1154, 1455, 1457, 1458 |
| 1298 | 110 | 132 | 1025, 1028, 1029 | 1054 | 198 | 244 | 1492, 1496, 1497, 1498 |
| 1298 | 143 | 210 | 1025, 1028, 1029 | 1054 | 285 | 319 | 1492, 1496, 1497, 1498 |
| 1295 | 17 | 87 | 1026, 1027, 1024 | 1056 | 191 | 237 | 1492, 1496, 1497, 1498 |
| 1297 | 32 | 102 | 1026, 1027, 1024 | 1056 | 278 | 312 | 1492, 1496, 1497, 1498 |
| 1294 | 127 | 153 | 1027 | 1057 | 14 | 60 | 1492, 1496, 1497, 1498 |
| 1295 | 17 | 46 | 1026, 1027, 1024 | 1057 | 101 | 135 | 1492, 1496, 1497, 1498 |
| 1297 | 32 | 61 | 1026, 1027, 1024 | 1057 | 233 | 264 | 1492, 1496, 1497, 1498 |
| 1298 | 5 | 57 | 1025, 1028, 1029 | 1060 | 269 | 315 | 1492, 1496, 1497, 1498 |
| 1320 | 249 | 268 | 1033, 1035, 1076 | 1390 | 10 | 50 | 1054 - 1057, 1060, 1492, 1496-1498 |
| 1324 | 2 | 23 | 1036, 1037, 1038 | 1390 | 142 | 173 | 1054 - 1057, 1060, 1492, 1496-1498 |

TABLE 4-continued

| QUERY Trigger | | | | QUERY Trigger | | | |
|---|---|---|---|---|---|---|---|
| SEQ ID NO: | start | end | SUBJECT Trigger SEQ ID NO: | SEQ ID NO: | start | end | SUBJECT Trigger Trigger SEQ ID NO: |
| 1326 | 14 | 38 | 1036, 1037, 1038 | 1391 | 73 | 104 | 1054 - 1057, 1060, 1492, 1496-1498 |
| 1326 | 95 | 117 | 1036, 1037, 1038 | 1055 | 85 | 131 | 1493, 1494, 1495, 1499, 1500 |
| 1326 | 152 | 174 | 1036, 1037, 1038 | 1058 | 117 | 163 | 1493, 1494, 1495, 1499, 1500 |
| 1326 | 227 | 248 | 1036, 1037, 1038 | 1059 | 118 | 164 | 1493, 1494, 1495, 1499, 1500 |
| 1327 | 44 | 65 | 1036, 1037, 1038 | 1061 | 109 | 155 | 1493, 1494, 1495, 1499, 1500 |
| 1321 | 65 | 86 | 1037 | 1062 | 222 | 268 | 1493, 1494, 1495, 1499, 1500 |
| 1321 | 88 | 132 | 1037 | 1063 | 262 | 308 | 1493, 1494, 1495, 1499, 1500 |
| 1322 | 2 | 34 | 1037 | 1054 | 15 | 64 | 1492, 1496, 1497, 1498 |
| 1322 | 36 | 67 | 1037 | 1054 | 165 | 196 | 1492, 1496, 1497, 1498 |
| 1322 | 135 | 156 | 1037 | 1056 | 8 | 57 | 1492, 1496, 1497, 1498 |
| 1322 | 158 | 202 | 1037 | 1056 | 158 | 189 | 1492, 1496, 1497, 1498 |
| 1323 | 1 | 35 | 1037 | 1060 | 86 | 135 | 1492, 1496, 1497, 1498 |
| 1323 | 37 | 68 | 1037 | 1060 | 236 | 267 | 1492, 1496, 1497, 1498 |
| 1323 | 136 | 157 | 1037 | 1386 | 199 | 248 | 1054-1057, 1060, 1496, 1498 |
| 1323 | 159 | 203 | 1037 | 1388 | 212 | 261 | 1054-1057, 1060, 1496, 1498 |
| 1324 | 2 | 51 | 1036, 1037, 1038 | 1391 | 286 | 335 | 1054-1057, 1060, 1492, 1496-1498 |
| 1324 | 56 | 93 | 1036, 1037, 1038 | 1384 | 311 | 351 | 1055, 1058, 1059, 1061-1063, 1500 |
| 1324 | 95 | 126 | 1036, 1037, 1038 | 1385 | 312 | 351 | 1055, 1058, 1059, 1061-1063, 1500 |
| 1324 | 194 | 215 | 1036, 1037, 1038 | 1387 | 83 | 123 | 1055, 1058, 1059, 1061-1063, 1500, 1057 |
| 1324 | 217 | 261 | 1036, 1037, 1038 | 1389 | 162 | 202 | 1055, 1058, 1059, 1061-1063, 1500 |
| 1325 | 2 | 31 | 1037 | 1296 | 69 | 101 | 1025, 1028, 1029, 1515, 1516, 1517, 1518, 1520 |
| 1325 | 33 | 64 | 1037 | 909 | 305 | 340 | 1531 |
| 1325 | 132 | 153 | 1037 | 960 | 70 | 101 | 1543, 1551 |
| 1325 | 155 | 199 | 1037 | 964 | 259 | 290 | 1543, 1551 |
| 1326 | 227 | 276 | 1036, 1037, 1038 | 1305 | 180 | 226 | 1133, 1137, 1138, 1580, 1581, 1583 |
| 1326 | 281 | 318 | 1036, 1037, 1038 | 1133 | 195 | 226 | 1580, 1581 |
| 1326 | 320 | 350 | 1036, 1037, 1038 | 1137 | 52 | 83 | 1580, 1581 |
| 1327 | 44 | 93 | 1036, 1037, 1038 | 1344 | 37 | 83 | 1133, 1137, 1138, 1580, 1581, 1583 |
| 1327 | 98 | 135 | 1036, 1037, 1038 | 1345 | 228 | 274 | 1133, 1137, 1138, 1580, 1581, 1583 |
| 1327 | 137 | 168 | 1036, 1037, 1038 | 1305 | 180 | 217 | 1133, 1137, 1138, 1580, 1581, 1583 |
| 1327 | 236 | 257 | 1036, 1037, 1038 | 1344 | 37 | 74 | 1133, 1137, 1138, 1580, 1581, 1583 |
| 1327 | 259 | 303 | 1036, 1037, 1038 | 1345 | 228 | 265 | 1133, 1137, 1138, 1580, 1581, 1583 |
| 1324 | 2 | 24 | 1036, 1037, 1038 | 1039 | 176 | 210 | 1590, 1594, 1597, 1598 |
| 1326 | 227 | 249 | 1036, 1037, 1038 | 1040 | 142 | 176 | 1590, 1594, 1597, 1598 |
| 1327 | 44 | 66 | 1036, 1037, 1038 | 1041 | 248 | 282 | 1590, 1594, 1597, 1598 |
| 1328 | 3 | 59 | 1039-1043, 1045, 1594, 1597, 1598 | 1042 | 141 | 175 | 1590, 1594, 1597, 1598 |
| 1328 | 70 | 146 | 1039-1043, 1045, 1594, 1597, 1598 | 1328 | 175 | 209 | 1039-1043, 1045, 1594, 1597, 1598 |
| 1328 | 148 | 215 | 1039-1043, 1045, 1594, 1597, 1598 | 1331 | 2 | 54 | 1039-1043, 1045, 1594, 1597, 1598 |
| 1328 | 232 | 263 | 1039-1043, 1045, 1594, 1597, 1598 | 1331 | 200 | 234 | 1039-1043, 1045, 1594, 1597, 1598 |
| 1328 | 328 | 350 | 1039-1043, 1045, 1594, 1597, 1598 | 1332 | 142 | 176 | 1039-1043, 1045, 1594, 1597, 1598 |
| 1329 | 22 | 53 | 1039-1043 1045 | 1333 | 176 | 210 | 1039-1043, 1045, 1594, 1597, 1598 |
| 1329 | 118 | 140 | 1039-1043 1045 | 1334 | 16 | 68 | 1039-1043, 1045, 1594, 1597, 1598 |
| 1330 | 31 | 62 | 1039-1043 1045 | 1334 | 214 | 248 | 1039-1043, 1045, 1594, 1597, 1598 |
| 1330 | 127 | 149 | 1039-1043 1045 | 1335 | 76 | 110 | 1039-1043, 1045, 1594, 1597, 1598 |
| 1331 | 28 | 84 | 1039-1043, 1045, 1594, 1597, 1598 | 1336 | 8 | 60 | 1039-1043, 1045, 1594, 1597, 1598 |
| 1331 | 95 | 171 | 1039-1043, 1045, 1594, 1597, 1598 | 1336 | 206 | 240 | 1039-1043, 1045, 1594, 1597, 1598 |
| 1331 | 173 | 240 | 1039-1043, 1045, 1594, 1597, 1598 | 1338 | 14 | 66 | 1039-1043, 1045, 1594, 1597, 1598 |
| 1331 | 257 | 288 | 1039-1043, 1045, 1594, 1597, 1598 | 1338 | 212 | 246 | 1039-1043, 1045, 1594, 1597, 1598 |

TABLE 4-continued

| QUERY Trigger | | | | QUERY Trigger | | | |
|---|---|---|---|---|---|---|---|
| SEQ ID NO: | start | end | SUBJECT Trigger SEQ ID NO: | SEQ ID NO: | start | end | SUBJECT Trigger Trigger SEQ ID NO: |
| 1332 | 2 | 26 | 1039-1043, 1045, 1594, 1597, 1598 | 1255 | 165 | 199 | 970, 971, 973-978, 1626, 1629 |
| 1332 | 37 | 113 | 1039-1043, 1045, 1594, 1597, 1598 | 976 | 129 | 163 | 1626, 1629 |
| 1332 | 115 | 182 | 1039-1043, 1045, 1594, 1597, 1598 | 1299 | 98 | 129 | 1126-1131, 1651-1653 |
| 1332 | 199 | 230 | 1039-1043, 1045, 1594, 1597, 1598 | 1300 | 312 | 343 | 1126-1131, 1651-1653 |
| 1332 | 295 | 317 | 1039-1043, 1045, 1594, 1597, 1598 | 1302 | 155 | 186 | 1126-1131, 1651-1653 |
| 1333 | 4 | 60 | 1039-1043, 1045, 1594, 1597, 1598 | 1303 | 140 | 171 | 1126-1131, 1651-1653 |
| 1333 | 71 | 147 | 1039-1043, 1045, 1594, 1597, 1598 | 1350 | 314 | 345 | 1144-1151, 1703 |
| 1333 | 149 | 216 | 1039-1043, 1045, 1594, 1597, 1598 | 1352 | 29 | 60 | 1147, 1150, 1151, 1703 |
| 1333 | 233 | 264 | 1039-1043, 1045, 1594, 1597, 1598 | 1355 | 32 | 63 | 1147, 1150, 1151, 1703 |

All of the materials and methods disclosed and claimed herein can be made and used without undue experimentation as instructed by the above disclosure. Although the materials and methods disclosed herein have been described in terms of preferred embodiments and illustrative examples, it will be apparent to those of skill in the art that variations can be applied to the materials and methods described herein without departing from the concept, spirit and scope of this invention. All such similar substitutes and modifications apparent to those skilled in the art are deemed to be within the spirit, scope and concept of this invention as defined by the appended claims.

SEQUENCE LISTING (1724 sequences)

SEQ ID NO: 1 - DNA, 959 bp, Phyllotreta atra
  misc_feature: ProsAlpha2
ttgtgtttattttatctttaccaaaaaaccgatgcagttcaaataatcaatatacacctaatgaatttcgttgaacaatgcaccgtttgcatagctcgaggtaaaaaataagaaaagaaaaatcaatgaatattaccttaaagtataaaattttatgtaccaaatacaggacaagcttaaggaatatttgccaaaaaatcttttactgtagaaggatcgaatctcctaaatccttgtggatcgcatatgccaacctcgatgttatcagcggtcatttggccctcgaaactttctttaagcgttaaaatggcggtgtgcacagcatcatccaattccaactcttcgctataccttttctcgaggaaggtcttcccgttgacgtaattctttcccattgcggtggctttccaagcgaaatacgccccggaaggatcgcactggaataagtaaggcctgttgttgtcccatccgcagatcaacagggacactccgaagggtctaactcccccggattgagtgtattcctgcatcacagtggctacacgttgaactagctgaacagtaggaattggttctttgtaaaccaggtaatactgttgggccattttacgcgcttgcttgaccaacaaacggtagtcgggtcccatcccggaatagaccattccgatgtgcttcgtgatcatttccactttgtggacgctgtgttcgtcgtaaagaatggatttgtgcttgttttccgtggctattaccactccatttgatgcttttattcctactgacggagcaccagccgctactgccgctaaagcatattcgatttggactagtttacctgaagggctgaaagttgttaaagaaaaactataacgttcagatgacattttcacaaatgattacttgcaagttatcaacaaatgtctatagaaaaattataggttagaatgtagctgacaggtgac

SEQ ID NO: 2 - DNA, 880 bp, Phyllotreta atra
  misc_feature: ProsBeta5
attacaagctacaattccgaggattacgagcgactcgcctacgacgagagcctgcagaagtattgcaccaatttcaagaatggcatgaacttagctgttcccccttttcctgatcccagcaacaactttgcaaggttcaccaaagatgataacggccgtgagatcaaaatcaagttcgaccacggtaccaccacattgggattcatgtacaaagggggcgtagtgctcgcagtggattcccgagccactggcggccaattcattggatcacaaactgtagagaaaatcataaaaatcaacagttttctactagctacaatggcaggaggcgcggctgattgcacctactgggaccgagtattagctaaacaatgtaggctgtacgagctgagaaacagggaacgtatctcggtggctgcggcttccaagttaatggccaacatggtttataattacaagggaatgggcttgtccatgggaatgatgctggctggatgggacaaaaggggtcctcaactctactatgtcgattcagaaggtctaaggacagccgggaaagtgttcagcgtaggttcgggttccatttacgctttcggggtgctggattctgggtacaaatgggacttatccgatgaggaagcttatgatttaggtcgtagatcgatttaccacgctactcacagagacgcctattcaggtggtattgttagagtgtaccacatgaaggagactggctgggtgcacatcgatgataatgattgcatggacttgcattacaagtttgtggaggaaaaggagaagatgggtggcgcttgaattaatttgtgaatttatattttttaagagtaataaatttcttttaataaatgcttgataagga

SEQ ID NO: 3 - DNA, 720 bp, Phyllotreta atra
  misc_feature: RpL19
cttcacctttatgacattgacagttcctaacgcagccatatttctttttcggatacacgttgttaagagcgtgtgaaaaatgagttcgttaaaactccagaagaggctcgcagcctctgttatgagatgcggcaaaaagaaggtatggttggatcccaacgaaatcaacgaaatcgccaacacaaattcacgacaaaacatccgcaagctgatcaaagacggtctgatcatcaagaagcccgtggcggtgcactcgcgcgcccgcgtccgcaagaacaccgaagcccgcaggaagggcaggcactgcggtttcggtaaaaggaaaggtacagcgaacgctcgaacaccaagaaaagaattatggattcaacgtatgagggtgctccgtcgtttgttgaagaagtaccgcgaggccaagaaaatcgacaggcatctgtaccattcgctgtacatgaaggcgaagggtaacgtgttcaagaacaagcgcgtcctgatggaatacatccacaagaagaaggccgagaaggcgcgcgccaagatgttggccgaccaggcgaacgccaagagaatgaaggtgaaacgggccagggagagacgcgaagaacgtatcgctacgaagaagcaggaagttttgcagaattaccagcgggaagacgaagctgccgctgctactaaaaaataggttattcttttttcatttgatgactaataaaaagttaa

SEQ ID NO: 4 - DNA, 1434 bp, Phyllotreta atra
  misc_feature: RpL3
gtgaattagacatgttgctggtgacgttttactttatctgccatttcatttttcgacgtcaacatgtcgcacaggaagtttagtgcaccccgtcacggatctatgggattctaccccaagaaaagatcccaaaggcaccgtggtaaagtaaaggctttccccaaagatgacccctcgaaacccgtccatttaacagctttcattggctacaaagccggtatgacccacgtgctacgtgaggcagacaggcctggttcgaaaatcaacaagaaggaaatcgtagaggctgtgaccattttggaaacccctccgatgattgtagtaggcgttgtgggttacatcgaaactccacatggcatgagggctttggccaccgtttgggctgaacatttgtctgaagattgccgtagacgtttctacaagaactggtacaagagcaagaagaaggccttcaccaaggcatccaagaaatggaccgacgatttgggtaaaaagtcaattgagcgcgacttgaagaaaatcgtcaaatactgcaaggttgtcagagtcatcgctcacactcagatgaaattgttgaaacaacgccaaaagaaagcccacattatggaaattcaactcaacggcggtaccattgccgacaaagtggcatgggctaaggagcatttggagaagcccattcccgttggcaacgttttcgctcaagatgagatgatcgattgcatcggtgtaaccaaaggtcatggatacaaaggtgttacatctcgttggcatacgaagaaattgccccgcaagacgcacaagggtcttaggaaagtcgcctgtattggagcctggcatccttctcgagtgtcgttcactgtcgctcgtgctggtcaaaagggttaccatcacaggacggagatgaacaagaaaatctacagaatcggcgctggaattcacactaaggacggaaaggtcatcaaaaacaatgctgctaccgattacgatcttagtgagaaaactattacaccgatgggtggtttccctcattacggtgaagttaacaacgacttcgtcatgattaagggttgttgtattggacctaagaagcgcgtcattacactgagaaaatctctcttggttcacactaagcgtattgctttggagaagatcaatttgaaattcatcgatacgtcgtccaaattcggacacggtagattccaaaccgccgccgacaaggctgcgttcatgggaccccttaagaaagatagagttaaggaagaagacaagactgcggctccagctgcagctgctgcttcgagttaatttttatgcaatgtattttattgttgacaatatacattgattcagagtatttatttttgttataattttatttattgttaccctctaatgtgctgtatttcattaattaataaaatggatgcatttaaa

SEQ ID NO: 5 - DNA, 691 bp, Phyllotreta atra
  misc_feature: RpL40
ggaaggagaaagaaaggaaaagatacaagatacgccattttgtgtctagtgtcgtaaagagaaagttgtgaaactaaaaacagctgttctttcatatcaaacttctgaaaatcattaaagaatgcagatcttcgtgaaaaccctgactgggaaaaccatcaccctcgaggtggagccgtccgataccatcgagaacgtgaaagcaaaaattcaagacaaagaggggatcccaccagatcagcaacgtttgatctttgccggcaaacaactggaagatggaagaaccttatctgactacaatattcaaaaagaatctactctacatttagtacttcgtctccgtggagggatgcaaatattcgttaaaacccttactggtaaaactataaccctcgaagttgaaccatctgatactattgagaacgttaaggcgaaaatccaagacaaagaggggattcctccagatcagcaacgtttaatcttcgccggtaaacaactggaagatggcagaacattgtctgactacaatattcaaaaagagtccacactgcatttagttcttcgtctacgtggaggaatgcaaatattcgttaaaactcttactggtaaaacaattactcttgaagttgaaccatctgatactatcgaaaatgttaaggccaaaattcaagacaaagagggaattcctcca

SEQ ID NO: 6 - DNA, 689 bp, Phyllotreta atra
  misc_feature: RpS21
ttttttttttttaaccttagaagatagtttatttattagaaaagtttaaattacattttctgaatgatttaacgaagttgtgatttagaagtttttggctaagattccatctttcttcgttaacctcacaatacaatcgtccgattctcccatacgcctgatagctccgcagagggcgtagcttttggaactttcggtcatccttccggttaaaggatcgacatcggctacgctgagttgaatgctagcgtggtccttagcatgaataattctgttgctagcagagcatttccttgggcagtacaagtcgacggtttcaccagcgtcgttttccatgttttatatgattgttataaaataacacacaagaaaatggatgaacgtcaaaaaagaaaggagacaatgttgccaacctgtagttacgaatttatttctttataaatttattttcatagagaaagaaatatgagagagttcgacgctgtactaaaaattggcatagcgtttgatgatcagcgctgcatgcggttcccgcggcttaaacgtgaactaagcaaggttcgattatgtagatttcttctgagtttctcaaaatcaaaaatagggggtaaatttatattttaattataaattggattgtgaaaattataaataaaaattacaacttttgttaattttataaatgtatt

SEQ ID NO: 7 - DNA, 591 bp, Phyllotreta atra
  misc_feature: RpS4
ggttttatggatgttatcaccattgagaaaactggtgaattcttccgtctcatctatgatgtaaaaggcagattcgctattcaccgtattactgctgaagaagctaaatacaaactgtgcaaagttaagagggttcaaactggtccgaaaggaattccgtttttggtgacccatgatggacgtaccatccgttatcctgatcctaatatcaaggtgaatgacaccattcaactagagatcgctacgtcgaaaattctggattacatcaagtttgaatcaaacaacttgtgcatgattaccggaggtagaaatttgggacgtgttggtacaattatgaacagggagcgtcatcccggttccttcgatattgtacacattaaggacgccaatggtcatgcttttgcaactagattaaataatgtattcgtgattggtaaaggagctaaagcctttgtatctcttccaagaggtaagggtgttaagttgtccatagccgaagaaagggataaaaggctagctgcaaaaacacactaaacatgtgttaatattattttcaataaaacttgcgaaaagtgttaaaaaaaaaaaaaa

SEQ ID NO: 8 - DNA, 3291 bp, Phyllotreta atra
  misc_feature: Rpn2
gcgtattttattatcatatgctcaacgatggcttatttataaaaatttatcgaagattacagcatacaagaaatatatgaataaataattcaacactgtatgtaaaaaaaacatcttaagctgaatgaaaaaaaccaagtttaatatttagattttagaaataactagtgaatttctctaatcctcggtccattcgaatggttctggtggttctggttccttttcatcatcgccctttggaccgaatgctgctacgggttccaccaattcctcttcaccaggtttcaaattgcgaaccataataatccctccgatcgaaacatccttcattgcaacgtattgcgagttatcattaagcgtaatcactttcagctgttgcctcatggtcctggcaggattttgcaggatttcgaaactaggctcgggctcctttttcttctcctccttatcatctttcttatcttttttgtcgtcgctcgacgacgccgcttttttatcgtcggttttcttatcatcggactttttctcctctttcttctcttcggttttcttctccttctcctccttctcgggcttcttatcgtctttatcttcgtccacatccattttctcatcgcgatgtttcctctcgtgatcccttctcctttgcctggcagctatactcaatacggcagtggtgactttctccctttcttcgcgtttcttttcctccatgggcgccgggtaggcgtacaagctcggcttcgcgttcgatttgaactccagtttaggcatcttaagttgagtgttcaacgctataacgcacgtcggggtaaaggctaaagccagacaatgtgacagagggaaccaataccaatactgcgtaaacaccaatgtaccgacaacggccagcatattagtgtggccagttctggattgcaacgatagagtcacgttcctgccaccggcgtcgattataccttgcgccaagatggcgccgaacttcgccatgacgtcttcgtgcttgttggagatgacttgggagtaggtctgcctgaagaagctgaccttcgggcaggtctgctcggtctgctggatgaggatcatcgcggaggcgatgagggccccctgccggacgaagttcaccggatcgaacatcaccatgggctcgagcagggctatggcctcgcgaaggcccgtgccggcgcaggctatgcccagcgccatggcggcgccgtaacgtacgtgggggttgtagctttccgctaacagggacaccacgctgggacattgctcgggggttctgaacaacaggaaaccgagcgctgtgactgccgctcttctcacgtcatcgtttacatcagaaaccgcaacgtgtaataattttctaatcgcctggttgtgtcccgtgccgcaataagccatagctaatgtatacatgccggatcttctcaggattggatccttatcagaagtaagctgttgtattagggtatcagcttcttctaatcggccgtacatcgtgaagcttataccaacagccaaaccgcgaagaatcttttcgtgttgactctcttgcgcgtacgctaccatatccataatcgtagtggaattactggatcctaacataaccatgcccatcgcaattccagcggcctctccggtattagcatcatcttgatagagattgaacttcagctgttcgtagacatcttgcctgtgtgtccccatggcagccaaaccaagccctaaacaaccgccgtgcctaaccatctcattctgagcgtctttcaattgaccgagaagataatcgattatattagcaccgtgattggcgtgtataagacccagagcgtataaaccaccgccttcggaatatccggaactcggcccgacttccttcggcaaatagctttgcatgagtgtcaaagcctcttgttcgtgtccacggtggatgacgccgagagacgctgttgctgtaagtttcgcccaattcgtagctcgagctagccattccaaattatcccttagaaattggtcgctggtagtaccgctgtgcatgaaagcgttagcgatgactgtagcagtgtggcaaatactaactcgaaccgtttctttggtttgcttcagaataagaagatcggcgtggttagatctaatgaggaattgaagatgaagttctattgatacttcgccggataggatggtatgcaatttttcaattcgcttttggtgttccttttcactttcagtcaaactctcaatagatttttcttcctttttagcctcgactttagtttcgctgctaaccggatctttgctagcctctgccgaagtgctactagattgttcagtagctttagctttcaccttttcctctaacagcgatggaatgggagcagtagctctaagggcaaccaaaactctttccaaaaactgttgggttgcagactcatacagatcgaaagctatttggtaagccatcaattcggactcttctttaccagacactaatttatccaaaatttctgcgactggcagtgcatcgtccaagaaaattagacattggcacatgttaacgtaatccggtgtagttaaaccgcgatacaagccaaccaacgatcttaaaacggtgttacgaaatgccctattctgaattaggctcatcgccacttggaaagcgtaggtgagcatgctaataatatcctcggcttgtgtgatagataattcgaagatgtccattctcctggtctctaaggcgagccccatagcctggcggttttgaccatcatctaaacaacgttggaacattcgatttacaatcgcttcgagtctcgaatcaataggtttcgcatcggttgcgccttctgccaaggcgatgcgttgttgtgtatagaagtcgatgcattttgcaagagtggtttcaacatattctgttctagcatttacgtcgaagagatcaccagctcccaaagcgtacgttaacgagtcttcgaacgcacccagatggtagtatactttactagcgactaaagcagctaactggtgttgttgaaacactttgtcttcgtgcagaatttctatcttttcaatagcttctgaaatttctggccagaattcgtcgactatggagtctagttttcttaacgcgaatactttaagttctggtcttggttcttctaaaagggatataatccccgcagccgaagtaatattcatcctttaagcgcttgaaaatatctcaattaaattttcagcaccagcacaaataaaaatttttaggaagtaaaatgtcaaaattgttttctgtca

SEQ ID NO: 9 - DNA, 1321 bp, Phyllotreta atra
  misc_feature: Rpt6
tccttctgcatgaccttggccacagccatttcgaaatcttcttgggtaacgtgcacccttctctctcttaacgcgtacataccagcctcggtgcaaacacccttcacttcggcaccgctagcgcccggcatcaattcggcgattttcctcagattgattcctctggtcaaattcatttttctagagtgaattttcaggatgtccaatcgggcttcctcgttcggtggcgggaattcgattttcctgtcgattctgccgggtctgagcaaagccgggtctaaaatatcgattctgttggtggccatgatgactttaatgtttttcgtcgcttcgaatccgtccaattgattgagcaactccaacattgttctctggacttcggaatcaccgcccgaacctgattcgatacgagaagatccaatagaatcgatttcgtccatgaaaattatggaaggtgcgtgttctctggccataacgaaaagttctctaaccatcctggaaccttctccgatgaatttttgcaccaactccgatccagatacacgaataaacgtacattctgtatgatgagccactgctctggccaaaagagtttttccagttcctggaggaccgtataaaagcacacccttcggttgagcgatacccaaggcatcgaaaagttcaggatgcttcacgggcaattcaatgacctctttgatttcttttatttgcttgtccagaccaccgaccatttcgtaagtggaatccggcactttttccaccatcataagagacactaaaggatccaccttattcggtaaaattttgtgcaaagtgtaagattcatttcgaagagcaactctacaattgggtgtgacatcgttaatgtcgatattcttatcgatatcgaccacaaattttccctccggatgaactttgacgaggactttcttcttgtccatcggttttactacttcacctacgtagcttccttgttcttgaagcaacatcagttcttctctaagcatacgaactttggcgttaagttcgttcctttgggcctgcaatcttcgaaggttttgactcttttcggcaacgataagttgcaattcttcgattttcgtaatgtaatacgacctgaagccttcccccttcaggcctccgtcgacctccatcttattgataacagtcatcgtcggtttttaatcgctcgatagttattagagcaatttttctatttgattcaataacaggaaacaccaaacaccatataactcggcaaagtgaaattccgaaaatcatttaatttgacttttgacacttgcgtgacgtaccagac

SEQ ID NO: 10 - DNA, 2552 bp, Phyllotreta atra
  misc_feature: sec23
cgcgtaaccttgaaatttgatagaaaagtcaaaagtcaaagtgcaggtgatcacgtatttactatacataacttttatttaatctcttttaaaacggaaacaatattttaaatcacgagttaatatcaagtttattgcatgctttaatttggcgaagacacgtaaaaaaaatgggtaacaggtcttcacttctgcttcgcgaagaagaaattgctcaaattcaaactgaaacaggctttacgccgaatcaaatcgaaaggctgtattcaaggttcacctcactggacagaggagactgtggaacactgagccgagatgatttcctgcggatacccgaactggcaattaaccctctgggcgaaagaatcgtgaattcgttcttccaaaacgacgatttcaacgacagagtaaatttcaggcaattcatgcaagtcctcgcccattttatacccatcaaaaagaacaaggaaaacaagctgaattctcgagaagagaaattaagatttgccttcaaaatgtacgatttggacaatgatgatatgatttcgaaggatgaactgttggccatattgcacatgatggtcggaacaaacataagcgaagaacaactgaacagtatcgcagagagatcgatcacagaagcagatgaagacggtgatcagatgatttcgttcgaagaattttgcaaggcgctgcaaaggactgatgtggaacagaaaatgagtataagatttttaaattaattgcggaaatcatgagtaaatcaggatatgtaaaacgcttaaaaattcttttaggcaatactctatattttgtgatagataaattatttattatgtaagtttattcgggaaatggtagttacctcacggttgtggctgtaagttatacatctgatgcatttttaggataaaggttttaaaaacgtcaaccgtttacacttgttttattcttattccatttaataatataatttgttactcgatgattttctaaataattcactttcattggatacattaaaatgtgtaaagtgaatgtagcttatcacaaacaaccaacatctgaaaatctatgaaataaatacataaaaaaatatttaagcttaaaattcatacaatttttttagtttgattagcaattaccacttaagccgtggacgaaactgccaattttttcaaatgatccataaatacttgaagtgatacatcgtctgttaaaaccggagcgccagcgtcccctccatatgaatacatgttattgtgagtctgactcggattgactttggacaataaaaatctagcctgcgatcctccttgttcggtatcgatatatctcggcatgggaaatctcgtttgtaatatctcttgagcatcgtccacgggcgcttgcaaaagttgcctaaagttttcgtattcgggcatatcctggtacttcaaatttcgccattgcgctatagtctctccgtggaatatcaaaatttggaaaaacgtgtccataagcagtattctatcgggctgtatggaactcgtatctaatagaacaggctccggagggccgttgaaactgtaactgtacaaaattggttgaatcatgatcaatgattgagtaagatcttctctcatcagcatatgtcgatagaacgacgtttcatcaggagaattattgaaaacttgcaggaactgagacctccttagatggtacatgaattgcggatagaggctaaagttttggcccaatctgaatgaaccagcatcgtctttattgtattctccgaatttttgacacaatcgaatcagcattctatcgacccatctcagaacgtcgggactttcatctgattcagctctataaacagccattctggccataattacagctgctgcttcttgatcaaaaccagcgctgatgtggtggatattagtagtggcgtcagcccagtttcgagccactgttgtcactctaattcttctttgaccactcgagtgttgatactgagtaatgaattgtatgcaacctcttcctccttgcggaatcggtgcagaatgctgattgacgacttcgaagaacaaggccatcgtagtgcttggagtaagcgtacacattttccattgtacagtgttgcccatgccgatttctgtgtcggagaccagttgacttttgacgtttaatgatacacaggatccaatgcctccttgcacttttaattctcgagaacatttcacttctaatgttccgttaaaagccattttcaaatcgtttttctgatctctggtaaacactctttggaacgtttgtttgaacaacgaggaattgaacgagtctcccatcaccatatgacctcctgtagaattgacgcattgcttcatttccatcaaaccagtttgatcaagagcgcaggaatagatgtcaatacaatgaccgttagtcgccgctctcatagccagagtatcgtaatgtttaatagcttttttcatgtatttcgcgttatctttttggatgtcatgatgggatctaataggttgtttcaaatcgtcattcaaaacttgacc

SEQ ID NO: 11 - DNA, 2471 bp, Phyllotreta atra
  misc_feature: sec6
aaaaaatgtctattttgacattaaagaatgaggttaacgtaaaaaaatcctcatagatatttgtttagaaaattagttatcaattaatagaatctacaaaatgactacaaaaaaaattaatatgagagagctggaagctactgctaaagcctcaggaacagccaaagtcattaacacattaaataggccaggccagttagaaaaaatcgaccaaattaagcaaaggtatgttcgaaaaaaagcatctgttgaagcccttctgaaatcggcaatgcaacagcaattggacggggttcgaactggattggtgcagttgcatcgatgtctcgaagaagtttgtgaaatcgatgatagtatgaagaaaatgtctgaattgtttgccgacgtgcctgaactcagcaagaagcttatcgatattagagatgaaaatatgcgtcattcacaatacgtaacagctaaagaaaacctcaagcatatttttactgttccggaaagtgttgagaaaacgaaagcttggattaacgaaggaaaattgcttcatacacatcaatgtttaagggatttagagaactcgagagacgacctactatttgagttacacaaactaccaaatcaatctgtgcatgacaaatcgatgttaaaagcatatttcgccgatgtggaagtactatcgaaattattggagaagcaactaacgttcattttatctagaaccttaaatacagtaagaaaagacccgacagtaatcgtaacagccttgcggatcatagaaagagaagaaaaagcggacgaagaagctttaaagcaacaaaaacaaactggattcattcctccagctcgaccgaagaaatggagagaaatggcttttaaaattttggagaagaccgtgtcatccaaaatcgagggtactcaagttgaagaaagagaggacaataaacattggcttatacgttatttagaactaattagaatgatgatcttagaagatttgagaattgttaaaacactctgtcttccttgttttccaccaagttacaaaatattagacaaatacattcatatgtatcatggtggtctttctgtacatctacaagaaattatacaaaacgggctcaaaggtaacgaatacgttacaatactttcttgggccttgaaaacgtataaatcaaaagacatgttgggccatccagatctaacagcttcaactgaaagtttacctcctttattacctaaagccgtgctagaccatttggaaggagactatttgaaaaatatcgaagggaattacagtgaatggatgcagaacactctcaaatcagaaaaagaggaatggagatcaaatactgaaccgttctcagaatcgtattctcggacaccggcccccattattatatttcaaatgattgatcagaatttgcaagtagccaaaacaataagtgaagaattaacaataaaagtactaaatttaagcatccagcaagtaattatatttgcagatgcttttagagaagcgattatcgaattcaagaataaatattttgaagacaggaaacaagttgtatattttactcaatacatgatcttaattatcaacaatatcctgcaacttgttgaattaggttctcaattggaaaaagaatatgttactaacaacagttcgcatgaacttactaggaattttggagcattaaaagcgacttatattaaaatgagaaacgaggcagtccattatctcttagaagaattatttgtcgactcggaccaacatttcgacaaactgtttacatcacattggttcgcttccaatcctgcggacacaatttatgtaaccatcgaagattacttccaggattacaaccgcttagtggaagcgaattacaaatatttaatcgagcaattaattacctccgtcggtagaaaatacctcacagccatgctgtccaggcgcatatcgtttaaaacttacgaagaatgcacgaaagcagcacaaaaagcgtcggaagaggccaaccgattgaacagattgtttcagacccttagcaaagacatcgaatgcgaaaacccattcgatgccatcattatgctctcggaggtattgaaaagtgatgacgatatgatgtcgtttgagcttcacagagtcgtggaaaaatatcccgatatcacggatgatcatctcctgaggttgctaaatttgagaggcgatctatcaaggtctgaagttagagacaaagttgcgcatatagataaacctaaagttctacacaaaagtacgatttttaggactttgttgtttccaaaacttgtaaatatcaatttgaacttttaaaattgtatatattttaacaatattaatgctcacgccatttttatttatttcattccatcctgtaagtctgtgctagactttataaaaataaatcattgtattataataaatgattgtcacacataatatgtacaataaattgagg

SEQ ID NO: 12 - DNA, 1356 bp, Phyllotreta atra
  misc_feature: shrb
gagcaattccgcaccagccagcgaacaaaccgatgaaccctctatttttgatggatgactaataacagtgaaataaatatcaaaagtgctgctcggtttttcgtagttttcccttatttccattggaaaaatgagtttctttagtaaaatattcggaggaaaggaaaaagacgagggccctacgcccggggaggccatccaaaagctcagggaaaccgaggacatgttatataaaaaacaagagtttttagaaaagaaaatagaggaatacactttagtagccaaaaagaatgcatcgaagaacaaaagagtggcgcttcaagcgctcaaaaagaagaaacgattggaaaaaacgcaactacaaatagatggaactcttacgacgatcgaaatgcaaagagaggccttggaaggagccagcaccaacacagccgtcttagactccatgaggaacgccgctgaggccctccagaaggcccacaaaaacttgaacgtcgatgatgtccacgatatcatggacgacatagctgaacaacacgatattgccaatgagattacaactgctattagtcaacctgtgggcttcgccgacgatttggacgaggacgaattggaaagcgaactggagaaactggaacaagaaggattagaggaagatttactgaaagttccgggtcctactgaattacccgctgtacctacgggggctatcgctaaaccggttaaacctgctgctaaaaaagtggaggatgatgatgacatgaaggaattggaggcttgggcttcgtaaggattgctcgaagtggtaacacgcgtgaaatggaacacacaaaaaaaatattgtagctattaacggcttgtttttttcggcttcaaggtttaggcgttacatctacttttctgataggtatatttcaaatatttgaagtccctcttgttatttttaattaactttaaatagtaacgatttattgtctatttttgtaatataagtgcaaatcagatatactttaatctccaattataaatatttgattatgtatcaataaactgtacaaaaagtatttgtttaatttgtcattacatattaatttggtatatctgatttacgaattaataaagaggataatattcacatacttattaggcagggcaattaattaattaaataattaacaacatttagctaaatgaatatgtaacttctttttgtacagatttaaagtattttgtaattgcacttaggtgatgttcaaaataattcgattagctttaaaagtactaaatgcatattgttcgttgttaaattgtataaagttcatatttgtagtaaacaattatctttttaaaaaaaaa

SEQ ID NO: 13 - DNA, 2859 bp, Phyllotreta atra
  misc_feature: Vps16A
tttttagcgatttttaataccaaattaacgaaaaagcgacgaaaaactgaaaatgtcggcggcaatgttgactgcagaatggtttcttttaggaagagattcatattacaggaaattcgaaatctactccatgtcatggcaaagggaggaaatcaatatggaatcgcttactttttccacggcctcatacggtggtcccatagccaccagaaacaatcgacagaaactgatcaaagtacaaggcggtcatcaaccaatcgtttccgtttattccgcatcaggaaaattcatttcctcctttaaatggactaaacgacccatcgtcaaaatgggctggactaatagggaagaattgctgtgcattttggacgacgccaccgtggtcaaacacgacatgttcggtaaatacctgcacgccttcaacgccgtcggcaggcaaaaggacgtcaaagtgacggacgctaaaatcttcactaattgtcacaatttgacgggcgtcgtcgtcatgacgtccgattggaaattctacgctgtcaataacgtcgatgaaccgaaaagtagacggttgtcggagttgcccagatctgctatccagcctactggttgggcgattgtttctgatgacaataggacggagattttggtggctagaagcttggaattgtacaggttgaaacaggacgaagatcgaaccagttcaatgctggaaccggatataacgaacaaatacacatctataatcaaaatgtcggtgtctttaaacgctagacatttggctttttacacggattccggttttttgtggttgggttcgacagatctgagaacgaaatattgcgaaatcgattgcgattttgttttcaaaccgaaacaaatgttatggtgcggtaacgaagccgtggtcatctattgggaaaaagacaatacgttaatgatagtaagcaagcacggtgaaaaattgaaacacttttacgagtcgacggtgcatttaacgccggaagtggacggcgtcaggatactgtcgaatcaacaacacgaattcctgcaaaaagtaccggaagtggtgcaaaagattttccgaataaacagcaccgaaccgggtagttttttgttggaggcttccaagcaattccagaaaggcagccacaaagccaacgaatacgtttgtttggtgaaaaacgatctggaaacggccgttaatcaatgcatcgaagccgtcagttatgaatttgacgttgacgttcaaaaaatcctactgagagctgctcaattcggcaaatgtttcgtgccgacgatgaagtccgacagttacgtcaacatgtgtcgaattttgagggttttgaacaacgttagagacccgaaaatcggaattcccatcaccattactcaattaaatttcacgaaaaccggtcgatcgtcgatcctcgtacgactcatcgccaggaatcactattatctcgccctgaaaatttcggaatatctaaaactaccgcccagggagggctccacgtatgttttggtgcattgggccaaacataaggtcggtcaaagtcgactcgacgaggagacggtcgccagagagatagccgccaaattgggcgaaaagggtagcggcggcggggtgagttttagcgaaatagcggcgacggcgtcggagtgcggcaggaaaaagttggccatcaagcttttagattacgaatcgaaggcgagcgatcaagtgaaattactattggaattgggcgaaaacgtgccggctttggtcaaagccatcgaaagcggcgatacggatttagtttatactgtcatattgaaattgagagaaaacatgcctttaggggactttaagatgaccatcagaaatttccctatcgctcaatcgctgttcataaaatactgtaaagagcacaacgcgcaggctctaagcgaaatttacattcaagaagacgatttttgcgctcaagccgaacttttcatcaaagactcgctggatgttaagaaaaaccacgcgaaagacgcccttttgtcgtcggccttggaggcgtacaaaaaatcccgcaaagacctcaacgccaccatcgtggaggaacacctgcgcttgtgcaggttccaaagggaattggaggatacgctgccggaggcgcgaggtggaaaattcgccggaaaatccgtacaagacacgtgtaaattactattggaattgaacgaaaccaaattggccgaaaagtttcgcaacgatttcaaaattcccgataaaagatattggtgggcgaaaatcgccagtttggccgatcgaaacgattggatcgaattggagaagttctccaaatggaaaaaatccccgatcggctaccatcccttcgtcgacgtttgtttggcgcacgataaaccgcaggaggcgttgaaatatttacacaaagttggcgaggatgtcaaagtcaaatattacatcaaagcgggacgtttagaggaagcagccgaaatagcctatcaacaaagggacgtccaaagtttgttgtacgttcagggaaaatgtcagggaaatcgattttccgacgaaaatcgacgacgattgatggagaaaatcgcccaaatgatcgcccaaatcgaatcgaaaaaataaaaacccggaaacatcaaaattcaatgattaaggggtgaggtacagttaaaacgccaaaaaatacgttttttttgataacatatttaaatatttcttatataaataatacatacagggtaaaccaaaattcagtgcaaagatttcaagggcatatttaccagccaaaaataagaaaattttttcatatagtcgtatgtcctaacttccttctgttccaacatacagggtgtcaaagttta

SEQ ID NO: 14 - DNA, 1131 bp, Phyllotreta atra
  misc_feature: VATP-E
tgatattttaagttttttgtgggttgtaacgaatattatctaataatgtttgtgcaattcgatgaaaaattgcaattaactagacaaccaattaatatagaatcaccccgtttgtttcattctacagaaaaaacctttctttttaattattaaagaatccaaaacgttcgaaaattgcgtagttaccaaattattttcagttttttatgggttgaatcgaaattaatactaaaaattttaatccattaagtgtacttttcattacatcctatttgaactatctaaagtactatattgaaaacccgataatcttatattgcagtgtaatttttacagaaaaaaacatcctatgtacatgcattacaatcgcctcccaatatttcttcaattaaaatcaaaacaaaaccggaacagcaaccgcaacattgcaatttaaaaaacaaaaacaagtttcacagaatattaaaatatacaaggaatgatacaatagagcaacgaattaatcctaaacaacatcatctgatgataacattacaataaattttataaatcgaatactattttatttcgaccgatgtaaatattatacgatcgcacaaaccccaagcaacctaatcggtgaatttcctgttcacgttacgcccgaacagagcgttacggatttgaggcaccaattgctgcgagatcaagtccaatcgcgcctccagcgtgttgttgatcttcactttgttcttcaacgccagcaaatcgatcccccccgtagtctcctgcgacaagtgcgactcgtcgtcgatcttcaggtgcacctccttgcccgttatgtccttgtacttggtctgcacgttgcccagaatcgacttgaccagctccctgtcctgcgggcgcacgcgcaccgttacttctttctcgaacagctggtagagtccttggaggatgaggctttcgatgatgtggccgtacttcccttggtctttggtgacttcgccgagtcgtttgcgggcgtcttccagcacggaccgaacgtggtcctctctcactttcaacaccttcagtctggcctggttcagcatgttggacgattggattttcttctggagttcgacttgtttctctttcttctcgtagtattcc

SEQ ID NO: 15 - DNA, 2566 bp, Phyllotreta atra
  misc_feature: VATP-A
agcaaatatggtccacgtgaaagtattgaatttgataagtttatcagttatttgtcagtcagctgacttatcttgtgacaagttgtggattttaagaaaatcgtcgatttgctgtacttgatagttcagtgggtgaggttgaattagaaacatcacgtctaatcgccctcgttttcagaacatccacaaaaatgtcgaaagtacgtgttggagacgaagaaaaagagagccagtatgggtacgtccatgctgtatctggtccagtcgtcacagcagaaaagatgtccggatctgctatgtacgaattggtacgtgtgggctacttcgaattagtcggtgaaattatccgtttggaaggagatatggcaactattcaggtctacgaagaaacttccggtgtaactgtcggtgatcccgtgttgagatcaggaaaaccgctatccgttgaacttggtcccggtatcatgggttcgattttcgacggtatccaacgtcctttgaaagacatcaacgttttgaccgaaagtatctacatcccgaaaggtatcaacgtacctgcgctatccagaacagcaaaatgggatttcaaccccattaacataaagttgggttctcatttgaccggtggcgatatctacggtatcgttcacgaaaacacgctggtcaagcacaaaatgcttcttccacctaaagccaaaggtaccgttacgtacatcgcagatcctggaaactacacagtagacgaagttgtgctggaaaccgaattcgacggcgaacgttcgaaatacactatgttgcaagtatggccagtccgtcaagccagaccggtcagcgaaaaattgcccgccaatcatcccttactcaccgggcaacgtgttttggacgctcttttcccttgcgtacaaggcggtactacagctattcccggtgccttcggttgcggaaaaaccgtaatttcccaatcgctatccaaatactccaactccgacgtcatcatctacgtaggttgcggagaaagaggtaacgaaatgtctgaagtattgagagatttcccggaactcagcgtggaaatcgacggtcacaccgaatccatcatgaaacgtaccgccttggtggccaacacctccaacatgcccgtggcggcccgtgaggcctccatctacaccggtatcacgttgtccgagtacttccgtgatatgggttacaacgtgtccatgatggccgattcgacctctcgttgggccgaggctttgagagaaatttccggtcgtttggccgagatgcccgccgattccggttacccggcctacttgggggcccgattggcctcgttctacgagcgcgccggtcgcgttaagtgcttgggtaaccccgatagggaaggctctgtttcgatcgtaggagcagtgtcgccgcctggtggtgatttctctgatcccgtcacttctgctactctcggtatcgtgcaagtgttttgggggttggataagaaactcgcccagcgtaagcatttcccgtctgtcgactggctcagttcttactctaaatacctgagagccttagatgatttctatgacaaaaactttgcggaattcataccgctcagaaccaaagttaaggaaattcttcaagaagaagacgatcttacagaaatcgtgcagctggtaggaaaagcttcattggccgaagctgataaaattacattggaaatcgccaagctgttgaaagaagatttcctgcaacagaactcgtactcatcgtacgacagattctgtcccttctacaaaaccgtgggtatgttgaagaacatgattgggatgtacgatatggcgagacacgccgtagagtcgaccgctcaatctgagaacaagatcacgtggacggtgatcagggattcgatgagcaacattctgtaccaattgagcagtatgaagttcaaggatccggtgaaagacggcgaggcgaagatcaaggcggatttcgatcagctgtacgaggatatccagcaggcgttcagaaatctggaggattaattcgtcgcagatatgttaggatttctctttaaatttttcagcagtgtaagttttaaagaaaaaagatagagataatatcaaatacaataaataattaagttaaaagtaagtcacctgtccctcaatttaataattaattgatgagccattttagtagcagagacggttggttgatatatattaccatgtaaaatattttatgtaaattgttgaatattgtatagttttttattggtgagggtacagtgcttataaatatttaaaaaattattcctgtcattccaatttattattattaagttcttcctttttttcatatctttttttaaacaggtgcttaattgtcatttatattcagtattaggtttttctttttttgattgtgtaaccctcctggtatcatcctcgtcgtttttatttacaatctgttgtaaaaaagccacgttcacttctattttatcaaacaattgtacagtatatcgtgaattaataaaataaaatatcgtgtattgtatcttattaatcgcagttaa

SEQ ID NO: 16 - DNA, 2429 bp, Phyllotreta atra
  misc_feature: COP I beta
accggctgcggcttctccaccaacttcaaatcgcccagcgtcgccaactccagcgtgcaattctgcagcgtgtcgctcgtttggttcaccaccaacacatccagcacgatatcgtactgattaacgtgcacatacgcttcggagtaaacaggatccgagaaacccgtcagctgggctattttattcaatttactcgagccgatggtggagtccgattgccccgtcttgccgcccatgagggcttgcgacagggaggtctcgaagacgttttcgccgagctcgccgctccggtcggtctccagttgcacgaaggtgatggcgtcgtcggtttggacggcggcccgggacttttctcgcgatttttgatcggtcgcctcttcggtttccttggccagcagcatgtcgttgagggcgttgcggcacagggccgagaacacttgaacgacgggctccgtgcgatcggatagcacgcgcagacagaagagaatgtggtcgttgtcgtcgttagttatctgttttaccggcaaacctgatttgcctaaatgcaaaatgccagccataatcagcataacttcagcatcgaatttattcctatcggaagcggaaacgttttcaccatatctcaacgccaatttggtcaaagtagaggccaaagaagctgcaatgaaaaaatctccatccatgagatattgcctcaatggaggtctcttctcttttgtagatttgctggccacgttgaaagcagattgagtggcgtaagttccatccgaagtaaccaaagtggtggccccggctggtgcatgagctggcgcactatcatctgtactacccgatataatcttttgctcagactccaacagagggcattcgcccaatgtttgaacaatctctttgattacagcttcgatgtcagcagtagatgtagcatattcacctaatatccaaagagcagctcgatgaactttcacagatttgatgtctttgaaggtctccaataatttctcgataatgagcggctccaaattatcgaatttctgtatggcttccctcaaaaatagcaacacatcggtggccgccaattcattgctatcagacaggaattccatcagaacaggaatgacggtagcagctatatcagggaatttgatgcaacaagaatgcaacgttctgaccaacagttgcctatatttcccagtatcctcgtgttcgctatccacagtcttcgacacctccttcttcagcacaaacaccatttcttcgacgttacgtgaagagaccaattcgagcgctaaattaagcgttttctttcgcacttccaaatcaggagccgacaacactctcaatatatccatcaccaagtcctgcaggactctctcgtggctgggatgctccttcaaggcgatcaatctatccaaaacgatcaatttgacgttgttgtcgctttctttaatgatcaattcaatgtaacaactggcggcggctttaatggccgtaggggcgctggacaaagtgatcagagtaccggccgcctcgtatctcacagcaggactgctcgagtttaatagattgtatatgcagcgaatgaacctggatctctcagttgggttagagtggcacactttgtatatcaattcaacgatcaccaactgcagaatatccccgaatgatgccacttgatctaagcaattggataggtaagttagtgctcgatcttgatcggcatgcaagagcatgaggaaagcgtttcttttgcaagacatgtcttgttcgccatctaggtaagtggaaatcaactcaggggcgtccggaatgagaaactcgaaattcttgtatatcgtaaaaatggccagaacggcattccttcggacgtagctgtgcctgtgctccaggcaaattcgaatgctgggcatcaagggctccaatagctcgggctccttcagcttgcataggaatctcaatgtggatcctcgcaggaattcgttggggtgttgcaggtcctttctgtaggcgtcgcaaactaggatcatttcctgcagtaatttgccatcaggggtggttttcggcacgatttcccaaaaaatgagcaaaagcttcttggccaggtgatcttgaagaggcagaacgtttcgtatgattgtcatcaggaatccattgggcaacctctcgcctgccagtatcatgtgaatgattctttccaaagcccttatcttcactttcacttcgcccttttcgagatccattttcaattgcatttcattgtaaggctccgaatcggtcggtaaattaattaaagtgtaacagggctgttcgaccgcggtcatgtttatttctgtttaattaacgcaacaatgccgtaaaatatcgaattgttattagaaaactaaaataaaagtttgtattattcgcgatacgtgtcaagtaaacgtttt

SEQ ID NO: 17 - DNA, 2915 bp, Phyllotreta atra
  misc_feature: COP I betaPrime
ttttttttttaattaatatataaagactgttttatttcttaaaataggaatgaacaatttacataataatataatactaaaaaactgcattaaaattatattcaatcacttaacaagtcgtcatctatattgatatccgttgtatctatattttcatcaatgttcactccatcaagatccaaatccaaatcgtcctcatcagcttcttcattatcaacagagggtttgttcgtttgttcaaccggtgtttcgccgagcaaattatcgaaataacttgcacctgaatttttgactttcgcttgaacctccgctatcatatttctgtcgtgattcggtgtaacggtgacagccgaagcggcaggaatgaaacccggttcgttttgttccaaatatttctgcgccgctatggcctcttgcagccctggaaacagattttcgtaatccttgggatcggccaaactttggccggctttctgattgacagtcgacaattgggccctccaaaggtccaccacctccgaaattttatcgggaagataagatctcgcgaaaaacgccgcttcgggaagcctaccggtgcttatcaaaatgtccagacatttgttcaagtcaccgactaataagtgggacaagaatgccaagttatgcttgccctcggcttccgtggcttcgcctaatgtcctcactacctcgtcatctccagaactggtagctaagagcaacaatccaccgtaatcttgggctttctgcatgcactctttggccaacacgagattattcgtggaggccgccaaatcggccagttggctccatttctgcgggttgttagcctcctgggccaacattttggccgtattcaaatcctccaaagccacggccaattcgaacctgtgctcggggtcggtactaacagccaaagcttgctgcttgaaaccctgcttttccaagaaatgagccaccctggttctatgttctttgggtatggaaggcaacactcggtcggccgtcgagaaatctcttctcataacggccgtttgatactccaacaccgaaagtagcaactggtagctaacgactcgcaattctttgtcgactaagtacagtctatcgtctttcgggacgtagccgagcacgtacaaaggcccgtctaggtgcgctatggtcaccaattcgccgccgacgaagtaattgatgcgattcacggcgttggtgtagatgaaacaatcgcccacccaaagccccgttcgaacggtctcgttgacttcgcctagaagattgaaggcggactccacgccgtcgtcggccacttggttgttttctttcgccttgtggacctcctccacgtcgtaggagagtataaaataactatcttcggtggctaaacacaccaatttgccgctgtccgaccagtagatcgaacggggctgtatttcgattcttctgaccaaatccaacgtttcccagtcgtagaaagccaatcccgagacggattttacccccaaaagataaccgccgtatataccttcggctccgaagtcggatttgaaattctttttttctttgaaatttttgaatattcttatagtggaaccggattctctgatggcgtattcgctggaatcctgcgcccaaacgaattcttgcgcgcttccgaaagctttatttctgagcgccatggcggtgtaaataatgtattccccgtctccacaaacgaccacaaatctaccattcggattgtgctgaatagtttgcgggtagatatcacaagcgcccatatctttgatagaaaccggcaagcgttcaccgtctcttatttcagcaccttcgggcaacgctttaagattagcttgctgtagttccgaatgtctggcccagatgattttaccgccgctggcgtccatactcacagcgggttcttctctaccgactttaaccagaatgctaccctcgtcgtaacccagcgccacgttattggaacctttcagacaaaaaatggtccatactctttcgaaaccgtagttcaaactgctctctaatcggtgcgtgttggcgtgccacactcgaaccgtgccgtcttcgctgccggtgagagcgatcggtaattccggatggaaacacacggccgtgacgttctgtccgtgcccctctaacgtttgtacgcacgttttgttctggtaatcccagattttaaccagcctgtcgtcggcgcccgatattaggtagggtttatcgccaccgtgatagtaatcgacgcaattaacgcccttttcgtgaccctccaacgtgaaattagcagtagaggcgcctaactgccaaacttttattgttcggtccaaagaagcgctggcgaacgtattgttgtctttggggttgatggaaatttgcatgatgtaatgcacgtgcccttcgaacacttgttggcacgcccacgctttttcccagttccacagctttatcagcatatcatcgctactggtcagtatgtaaggttgtgtgggatgaacaacaatggatcgcacgtaatcagagtgagcttcgaaagcgtgcacgcgatctagagtgttgtaattgaaaactctgatttgcatgtcatcggagccactaacgatccagtttttcctcggtacgaatttggccgctctgaccggtagatcgcacacttcgaatgttttgacgagctgctggttttcgtggttccacacgtttatgttgccgctgtatagggaacagagcatccaaggctccgtgggatgtaggtccacgcattttacccggtcagaacgggctgttagctttcttttgatgtctaaccgaagtggcatttttaagcggttttatttaagaattttatttattttcttcaattgacacgaattataaacacatcacacatcaccattctacaaatgtcatcg

SEQ ID NO: 18 - DNA, 1596 bp, Phyllotreta atra
  misc_feature: Act5C
cttgcgttagcctactgcgagtacagcttgtttgttagaaaaattcggctgtgcctttttttgttcgattatccaaccacctactagatttttcaaatactaattcaaaatgtgtgaagaagaagtcgccgctttagtcgtagacaatggctccggtatgtgcaaggccggtttcgccggagacgacgctccgcgcgccgtctttccctccatcgtcggtcgcccaagacatcaaggagtcatggtcggtatgggtcaaaaagattcctacgtaggtgacgaagcccaaagcaaaagaggtatcctcactttgaaataccccatcgaacacggtatcatcaccaactgggatgatatggaaaagatctggcaccacaccttctacaacgaactccgtgtggctccggaagaacaccccgttcttttgaccgaagctcctcttaaccctaaagccaacagggaaaagatgactcaaatcatgtttgaaaccttcaacacccccgctatgtacgtcgccatccaagccgtactttccttgtacgcttccggtcgtaccaccggtatcgttttggactccggtgacggtgtcacccacaccgtacccatctacgaaggttacgctttgcctcacgccatcctccgtttggacttggccggtcgcgatttgaccgactacctcatgaaaatcctcaccgaaagaggttactcattcaccaccaccgctgaaagagaaatcgtccgtgacatcaaggaaaaactctgctatgtcgcattggacttcgaacaggaaatggccaccgccgccgcttccacctcattggaaaagagctacgaattacccgacggtcaagtcatcaccatcggtaacgagagattccgttgtcctgaggctctattccaaccttccttcttgggtatggaatcctgcggtatccacgaaaccgtctacaactccatcatgaagtgtgacgtcgatatccgtaaggacttgtacgccaacaccgtcttgtccggtggtaccaccatgtaccctggtattgctgaccgtatgcaaaaggaaatcaccgccttggcccccagcacgatcaaaatcaagatcatcgctcccccagaaaggaaatactccgtatggatcggtggatccatcttggcttctctttccactttccaacagatgtggatctccaaacaggaatacgacgaatccggccctggaatcgttcaccgcaagtgcttctaagctatttactacttttacctatattatatatactactatatcatgttgtttgtactgtattttacatcaattatgcgaccgtggttgttttactgccagacagacatttcaagatcattttaacaccttatttgttatatataaatatattttaatttgtaaccgggcaggttgaaataaagcctatctaagtaaaaaaacctgcctcttttatttctaatttttaagacaaaacgaaacgagaatatgatgttatgttatattatataataactattgtaacatttttttttaataaatttttggcatagtttatacaatatatatatatatatacacacacaataaaattcaaa

SEQ ID NO: 19 - DNA, 3693 bp, Phyllotreta atra
  misc_feature: COPI alpha
cgcgctcattgtaagtcagccgaaatgttgaccaagttcgaaaccaaatcagcaagggtaaaggggctgtctttccatcccaaaaggccatggattttagccagtttacacaacggctgcatccagttgtgggattatcgaatgtgcactcttctggagaagttcgacgagcacgatggacccgtaagaggcatatgtttccacagccaacagcccctattcgtatcaggtggcgatgattacaaaataaaagtatggaactacaaacagaaacgttgcatcttcacactgcttgggcatttggattacattcgcacgactatgttccaccacgaatatccctggatagtatccgcatccgatgatcaaaccatccggatatggaactggcaatccagaacgtgcatttgcgttttaaccggccacaatcactatgtcatgtgcgctactttccatcctagcgaggatctactgttatccgcttcattggattctactgttagagtttgggatatttctggactacgtaagaagaacgtatcaccgggtccctcggggctcgaagatcacctcaaaaatcctggcgctactgagctattcggccaagccgatgctgtggtgaaacacgttttggaagggcacgatcgaggagtgaattgggcatcttttcatcctttcctacctttaatagcttccggagccgatgacaggcaaataaagctgtggagaatgaacgattcgaaagcttgggaagtagatacttgtagaggacattacaacaacgtgtcttgcgttttgtttcatcctagacaggagctgattctgtctaacggtgaagatagaagtataagggtttgggatatggctaaaaggacttgcttgcatacttttagaagggaacacgaacgattttgggtgatgacgagccacccgaatcttaatttattcgctgctggccacgatggcggcatggtgatattcaaattagaacgcgaacgaccagcttacacggtacacgggaacctactgtattacgtcaaagagaagtatttaagaaaactcgattttaccacttcgaaggacgtccccgttattcaaatcagaggcggcggtaaaataccagtatacaagatgtcctttaatcctgccgaaaacgctgtactactatctactcgcacttccaatctggataacagcacatacgatttgtacatgattcccaaggatcaagaaagggaggatcacgtgcctgaagccgaaagcaagagatcatcgggtcttaccgctttgtgggtggccagaaatcgatttgctgtactggacaggacgcaccagttgatcattaaaaatctgaaaaacgaggtaactaaaaaagttcaaacgcccacttgcgatgaagtcttttacgccggaactggcatgcttttattgagagattccgaacacgttacgttgtttgatgtccaacaaaagaggacattggctcaagttaaaatcagcaaatgtagatacgtcgtgtggtcttctgatatgtcgcatctagctcttctatctaagcataacgtgacgatttgtaatagaaaattggatgttctgtgttcgttacacgagaataccagagttaagtcgggcgcttgggatgatagcggcgttttcatttacactactagtaatcatattaaatacacgttgaaaaatggtgatcacggaattattagaaccctggatcttcccatttacataactagagtcagaggtagtcaggtgttctgtttggacagggaatgtaagcctcgcctgttggtaatcgatcccactgaatacaaattcaaactcgcattgatcaatcacaagtacgaagaggttttgtacatggtcaggaattctcgattggtaggccaaagtattatatcctacttgcaacaaaaaggatatccggaagtagctttgcattttgtaaaagatgacaaaactaggtttgctctggctttggaatgcggcaacattgaaatcgctttagaagccgctaaagctctaaacgataaaaattgttgggatcaattagcacaagccgcattgtggcaaggcaatcatcaaatcgtagaaatgtgctaccaacgtacgaaaagcttcgagaaactatcgttcctctacctaatcaccggcaatttggagaagttgagaaaaatgatgaaaatcgctgaaattagaaaggccagatcgtcccaataccacgccgctttgctgttaggggatctcgaagaacgtgtaaaactactcaaagcttccaatcaattatctctagcgtatttaaccgccgccacgcacggtatgcgagaggaggcagagcaactcaaagaacaaatcggcgatgataaaaaactacccgatgtcgatcctaacgcgaagttcttgaaacccccaccgccgatccaacaagccgaatccaactggccattactcacagtcagcaggagtttcttcgaaaataccgctgccgtggccaccgcatcggccaacatgaaatccctgatggccgaaccgatttccgacgtcggaatggaggacgcccaaggatggggcgacgacgacgagctggaattagaccccgaagacaaaaaagccgaggtcgtcgcggccggcggcgacggcgaaggcggctgggacgtcgaagacgaaggtctggaaattcccgatttaggacccaccgccgcggcggaaggcgaaggaaatttcgtgcatttacccacgcaaggcccctcgccgcctctaacgtggacgaaaaactcgcaattggtggccgatcacgtggcggccggttcgttcgaatccgccgctcgattgcttcacgatcaactcggaatcgtcgatttcaaaccgttcgaaagcttgttcatcaatttgtacagtacttcgaagacggtgtcgtcttggcaacaaaacgtaccgccttcgtttagttacccgttgagaaactggaaggaagccaatattaaaaaccagttacccgcttctggggtgaaattgaacgatttggtcgctaaattgcagatttgctatcaactgaccactggtggtaaattcactgaagccatcgagaaattacaaactctgctgttgtccgttacattgcttgtggtggacaacaaacaagaaatttccgaggctcagcaattactgagaatagccagcgaatatatttgcggtttgcaaatggaaaccttgaggaaaaccttaccgaaaacttcagccgaagagcagaaacgtcagtgcgagatggctgcctatttcacgcattgtaaactacagccgatacatcaaatcctcacgcttaggacggcgctcaacatgtttttcaagctcaagaactacaaaacagccgcttctttcgccaagaggctgttggaacttggtcctaggcctgaagtagcccagcaagctagaaaaatattacaggcttgcgattctaatcttacagatgatttgcaattgcagtatgacgagcacaatcctttcaacttgtgtgggcactcttatacacccatttacaggggaaaggccgaagagaaatgtccattatgcggtacttcatatttacctaaatacaaaggggtattgtgtaatatttgcaaagtggcggaagttggaaaggatacgattggattgaggattagcacgcatcagtttaggtaa

SEQ ID NO: 20 - DNA, 3693 bp, Phyllotreta atra; identical to SEQ ID NO: 19
  misc_feature: COPI alpha

SEQ ID NO: 21 - DNA, 3693 bp, Phyllotreta atra; identical to SEQ ID NO: 19
  misc_feature: COPI alpha

SEQ ID NO: 22 - DNA, 3693 bp, Phyllotreta atra; identical to SEQ ID NO: 19
  misc_feature: COPI alpha

SEQ ID NO: 23 - DNA, 3693 bp, Phyllotreta atra; identical to SEQ ID NO: 19
  misc_feature: COPI alpha

SEQ ID NO: 24 - DNA, 3693 bp, Phyllotreta atra; identical to SEQ ID NO: 19
  misc_feature: COPI alpha

SEQ ID NO: 25 - DNA, 3693 bp, Phyllotreta atra; identical to SEQ ID NO: 19
  misc_feature: COPI alpha

SEQ ID NO: 26 - DNA, 3693 bp, Phyllotreta atra; identical to SEQ ID NO: 19
  misc_feature: COPI alpha

SEQ ID NO: 27 - DNA, 3693 bp, Phyllotreta atra; identical to SEQ ID NO: 19
  misc_feature: COPI alpha

SEQ ID NO: 28 - DNA, 3693 bp, Phyllotreta atra; identical to SEQ ID NO: 19
  misc_feature: COPI alpha

SEQ ID NO: 29 - DNA, 3693 bp, Phyllotreta atra; identical to SEQ ID NO: 19
  misc_feature: COPI alpha

SEQ ID NO: 30 - DNA, 3036 bp, Phyllotreta atra
  misc_feature: COPI delta
atatcttacacgatgagttccaagatagatccggctaaactgaaggtagtagatttacggaatgaactttcggctcgagggctcgacgtgaaaggcaccaaacctatactcgttaaacgtttaaaagaagctttagagaacgaattagatgaagaaatagctgatacatcaatattagatacctcgacagaggaagtcgaagaagacctaacgccaaaaaataccttgcttacggaagcaaaggatgaagcgagggtcaaggagagcgccccgtctccagaaaagcaacaacccgacgagggtaaatccgaaacaaccaacgaacctgtggcaacactagaacctacaccggtgcctgaaatcgaatcgacgcctgcgccagtcgtacctgaagctaagcctacgcctgtacctgaggaatccaaacctttggtgaaatcgcctgaagatggcccagtcgaatcatctgaaacgcctacaatagaagacgatgacgctgaacaacaagaagagtcgaatacaactgagaatcttcccacttctgcggaagctaattccgaaaccattgacgaagctaaacccgaacaagaaaatggagaacaggaagagaaaatggacgctcaggacgatgcctcgaagacagcggaggaaaaggatgccgatgaccaacaaaaaggggaaaagcgcaagagaagcagcgattcgcctgatcgatcgcacaagcgaccgaggactcccatcaaagaagatgagcctgacataaacgccgaggctgtacagctcagctggtacgattcagatctatacttgcaagttgacaaaagttcatttttatccgccaagccaatgaacgatggagcatttggatatgtatgggccggagctagagctacacacggtatttccacaggaaaggtttattacgaaatgaaagtaactgagaaattaaaatgggacgattggcaacaacaaccagatcatcgagataaccggtacaggtcggatagacgaagcagaagagattattacgacagagacgataagagaaacgctgataacgtcaaaaacgattcagagaaaccgaaagaagaccccaaagagactgataacgtgagtgagaataaagacgaagaaattcccagcgagaaggaagagaaggatcaaaccgaggctgaggcagtggaaccaatggagactactgagagtgaagtaaacgagaagaaagatgaggacaaacaagacgagaaagacgatcagaatgaaacagatgagaagaatgagcaagacggtaaaaatgaacaggacgataagatcgaaaaagaggacaaaaaggaggaaccggctgaagaattcgttcctatacccactcactttattagattgggttggtcagccgcttggacttcactacaattgggtgaagatgataaatcatacggctacgattcttcaggaaaaatcgttaaaaataaggagttctctgattacggaataacattcgacgttggagacgtaatcggtgcatttttggacatcaacgactcttctataacgctacagttcaccgtgaatggacaaattcaaccgactattgaaatacccagggacgatttacccgatgatttgacgctaatcccgcacgttctatcccgaaactacgctttggaattgaatttcggcgaacaggaggaaccctggtttgtcgcaccctcggaactttccgactatcaatttctgagcaaagtggaaaacaaagtagccggcccagcgagacctgaaagtcgatcggactgcgaagtacttatgatgtgcggtttacctgcttcgggaaaaagcgaatgggtgaaaaatcacgttgctactaccgatgttgataaacattatacggtattgggtgtttcgaatttatttgaaaggatgacggtatttggagaaccaatgaagtcgaagttcaagggtaaatggagcactctggtggacaggatctcgaaaattttgaatagattagtattcatggcggctcaaagaaggaggaactatattatcgatcagacaaacgtgttcccatcagcccagcgccgtaaaatgcggccgtttgagggcttcaagagaaaggcgatcgtacttgtaaatgaagacgaagaacaggctagacgtcaggctttgcaagagaccctggagggtaaagaggtccgcgatagtactttacttgacatgaaagctaccatggctatacccgaaactggagattggatcgaagaggtcgtttacgtcggcgtagacgaggaaaaggccaagaaaatcatcaaggattacaacacagagggtcaatcggccggctacgggcacgagaaaagatacaagagagattggtggaaccaaaacaaaagaaataactaccgctcgggaaggaactaccaacggccaagaggcggcggctacaaccgccaatacggcccgtccccgtgggttcaatcgagacaaggcggcggcggcggtggaggatggaaagatcaaagaacacgcgaatggagaggcaacgattacaacagaagagacagggattattattcgcaatccggctatggtggcggcggtcgttatcaatcgagcaacagatcgcagggcggcggcggtcagcgttggggcggtaacggcggcggcggtggttcgtggggaggcggttggaatcagcagagcttcggcaggcagaattggaataatcaaggaggcagcggtggcggcggcggtcaaggcaactggagcggcggtaaatacggttcgtccggttcgggatacaacagctggagttattacggtcaacagcaacagcattggagcggacaggggcagcagcagcaacaacaaagtcattctggttatgcgatgaatacccagagtcagggtcaaacgcagggccagtattcccaagcttatagtacccaggaagcgtgggcacaatacgccaagcagtatgctcagcatcagcaattggcacaaaatcaagcggcggctgatacgacccaaaacaaataa

SEQ ID NO: 31 - DNA, 3036 bp, Phyllotreta atra; identical to SEQ ID NO: 30
  misc_feature: COPI delta

SEQ ID NO: 32 - DNA, 3036 bp, Phyllotreta atra; identical to SEQ ID NO: 30
  misc_feature: COPI delta

SEQ ID NO: 33 - DNA, 3036 bp, Phyllotreta atra; identical to SEQ ID NO: 30
  misc_feature: COPI delta

SEQ ID NO: 34 - DNA, 3036 bp, Phyllotreta atra; identical to SEQ ID NO: 30
  misc_feature: COPI delta

SEQ ID NO: 35 - DNA, 3036 bp, Phyllotreta atra; identical to SEQ ID NO: 30
  misc_feature: COPI delta

SEQ ID NO: 36 - DNA, 3036 bp, Phyllotreta atra; identical to SEQ ID NO: 30
  misc_feature: COPI delta

SEQ ID NO: 37 - DNA, 3036 bp, Phyllotreta atra; identical to SEQ ID NO: 30
  misc_feature: COPI delta

SEQ ID NO: 38 - DNA, 3036 bp, Phyllotreta atra; identical to SEQ ID NO: 30
  misc_feature: COPI delta

SEQ ID NO: 39 - DNA, 3036 bp, Phyllotreta atra; identical to SEQ ID NO: 30
  misc_feature: COPI delta

SEQ ID NO: 40 - DNA, 3036 bp, Phyllotreta atra; identical to SEQ ID NO: 30
  misc_feature: COPI delta

SEQ ID NO: 41 - DNA, 933 bp, Phyllotreta atra
  misc_feature: COPI epsilon
aaaaaaatcaaaacaaaaatggcacgtcagcagcaagacgtagacgagcttttcgaaattaaaaactacttttacataggaaactaccaacaatgcataaacgaagggcaaaaactaagaaagccctcaaccccagaagtcgccatccagcgagacgtattcacctacagatcgtacatggcccagaacaaattcttagtcgtactagacgaaatccacggggcctcctctccagaaatccaaccactaaaactcctggctgagtacctatccggtaaagtcaagaaggatgccgtagtgtctcaaatcgaccagcaagtaatggcgaacgccagcaacgacaccctagtgttgactgcagccactgtttacgtcaacgaaggcaacttggaagccgcttacaaagtgcttcacgcttcggaaaatctggaagcttacgccttcatcatcgatatattattgaagttagatcgggtagatttggctaagaagaagctcaaggaaatgcaggataaagatgatgatgctacgttaacacagctagcgcaagcttgggttaatgttgcaattggaggtgataaattgcaagatgcttactacatttaccaagaaatggttgataaatatggctcgacgcctcttctgttaaacgggcaagcagtggcctttatagggcaggctaaatacgaggaagctgaagctgctttgcaggaagctatagataaagatgctaattatcctgatacattggttaatttaattactcttcaaaggcatatggggaaaggtcctgagattgctaatagatatttatcgcaattgaaagacgccaatcccgaccatccttacataaaggacttgaagcataaagagagcgagttccagagaatatgtcaacagtatacacctacagtaattaccattccatcgtaa

SEQ ID NO: 42 - DNA, 1008 bp, Phyllotreta atra
  misc_feature: COPI epsilon
aaaaaaatcaaaacaaaaatggcacgtcagcagcaagacgtagacgagcttttcgaaattaaaaactacttttacataggaaactaccaacaatgcataaacgaagggcaaaaactaagaaagccctcaaccccagaagtcgccatccagcgagacgtattcacctacagatcgtacatggcccagaacaaattcttagtcgtactagacgaaatccacggggcctcctctccagaaatccaaccactaaaactcctggctgagtacctatccggtaaagtcaagaaggatgccgtagtgtctcaaatcgaccagcaagtaatggcgaacgccagcaacgacaccctagtgttgactgcagccactgtttacgtcaacgaaggcaacttggaagccgcttacaaagtgcttcacgcttcggaaaatctggaagcttacgccttcatcatcgatatattattgaagttagatcgggtagatttggctaagaagaagctcaaggaaatgcaggataaagatgatgatgctacgttaacacagctagcgcaagcttgggttaatgttgcaattggaggtgataaattgcaagatgcttactacatttaccaagaaatggttgataaatatggctcgacgcctcttctgttaaacgggcaagcagtggcctttatagggcaggctaaatacgaggaagctgaagctgctttgcaggaagctatagataaagatgctaattatcctgatacattggttaatttaattactcttcaaaggcatatggggaaaggtcctgagattgctaatagatatttatcgcaattgaaagacgccaatcccgaccatccttacataaaggacttgaagcataaagagagcgagttccagagaatatgtcaacagtatacacctacagtaattaccattccatcgtaaatattatgattgtataaagaaaacattgtgtaaacaaataaaaatacattttaatctactattaaaaaaaaaaaa

SEQ ID NO: 43 - DNA, 1008 bp, Phyllotreta atra; identical to SEQ ID NO: 42
  misc_feature: COPI epsilon

SEQ ID NO: 44 - DNA, 1008 bp, Phyllotreta atra; identical to SEQ ID NO: 42
  misc_feature: COPI epsilon

SEQ ID NO: 45 - DNA, 1008 bp, Phyllotreta atra; identical to SEQ ID NO: 42
  misc_feature: COPI epsilon

SEQ ID NO: 46 - DNA, 1008 bp, Phyllotreta atra; identical to SEQ ID NO: 42
  misc_feature: COPI epsilon

SEQ ID NO: 47 - DNA, 1008 bp, Phyllotreta atra; identical to SEQ ID NO: 42
  misc_feature: COPI epsilon

SEQ ID NO: 48 - DNA, 1008 bp, Phyllotreta atra; identical to SEQ ID NO: 42
  misc_feature: COPI epsilon

SEQ ID NO: 49 - DNA, 1008 bp, Phyllotreta atra; identical to SEQ ID NO: 42
  misc_feature: COPI epsilon

SEQ ID NO: 50 - DNA, 1008 bp, Phyllotreta atra; identical to SEQ ID NO: 42
  misc_feature: COPI epsilon

SEQ ID NO: 51 - DNA, 1008 bp, Phyllotreta atra; identical to SEQ ID NO: 42
  misc_feature: COPI epsilon

SEQ ID NO: 52 - DNA, 2016 bp, Phyllotreta atra
  misc_feature: COPI gamma
gatttcatcgagtcctgtctgagacacaaatccgaaatggtagtttacgaagctgcccacgccattgtcaatctaaaacgcactactagcaaagaattagcgcctgccgtaagcgttttacaattattctgcggttcaccgaaggctactttaagatttgccgctgtcagaacattgaatcaagtggcgatttcacatcctgctgctgttacggcttgtaatttggatttggagaatctgattaccgattctaacagatccattgccactttagctattactactttgttgaaaacaggtgctgaatcttcggtcgatcgtctaatgaagcaaatagcgagtttcgtgtctgaaattagcgatgaattcaaagttgtggtagttcaagcgatcagagcactggctcttaaattccctcgtaaacacaacacgctcatgaactttttatcggctatgctaagagatgaaggcggtttggagtacaaagcttccattgcagacaccataattaccataatcgaagataatcctgaagctaaagagtcaggtttggctcatctgtgcgagtttatcgaagattgcgaacacgtttcattagctgttagaatattgcatctgctaggcagggaaggaccgaaaaccaaacaaccttctaggtacatccgcttcatctacaaccgcgtcatcttagagtgcccttccataagagcagccgctgtttccgccatggctcaattcggagcttcgtgtcccgatttgttagaaaacattcaagtattactagccagatgccaaatggactcggacgatgaagttagagacagagccacctactacagcagcatactcaataaaaacgataagaacttgtacaacaattatatcctggatactttacaggtatccataccgtcgttagaacgctcgttgaaagagtacacgcagagccctacgaatcaaccgttcgacataaaatcagtcccattgcaagtgggcccgtctccggacgagcgcgagaagaaacacaagtccgaaggtatgttaacatcgcaaggacccttgcggccgccgcccgtctcccgcgaggagaacttcgcggagaaactgtccgccataccgggcatccagcagctgggcccgatcttcaagagctccgaggtggtggagctgaccgaatccgagacggagtacttcgtgcgctgcatcaagcactgcttcgcccgccacgtggtcctgcagttcgactgcctgaacacgctggccgatcaattgctggaggacgtgcgcgtggagctggagccgagcgaggggttcgagttgctgtcggtggtgccgtgcaagcagctgcactacaacgagaccgatcacacctacgctatattgaagttccccgacgacgatttgccgagttgcgtcggtacgttcggggcggtgttgaagtttatcgttaaagattgcgatcccaccaccggcattcccgatagcgatgaaggttacaatgatgaatacatactcgaagacttggaaataacgttgggcgatcagatacagagagtgagcaaaggcaattggggcgccgcttgggaatcggctgctgagggttccgtggaaaaggaggatacgtattctctcagttcgatgaatacgttggacgaagctgtgaagaatatcgtgcagttccttggattgcaaccggccgaaagaactgataaagtgcccgaaggcaagagcacccacacgcttctactatcaggagtctttagaggaggaatcgatattttggtaagagctaaacttgctttggcggatggtgttacaatgcaattgactgtaagatcacccgatgacagcatagctgagcttattacctcttctgtaggttaagatataaatattttatttactatttaattaaatgtattacaatattccttataattaaatttttcgataattcggaggattaaaagttattctagagtttatttaaatgacgaattgattttcctggcattt

SEQ ID NO: 53 - DNA, 2016 bp, Phyllotreta atra; identical to SEQ ID NO: 52
  misc_feature: COPI gamma

SEQ ID NO: 54 - DNA, 2016 bp, Phyllotreta atra; identical to SEQ ID NO: 52
  misc_feature: COPI gamma

SEQ ID NO: 55 - DNA, 2016 bp, Phyllotreta atra; identical to SEQ ID NO: 52
  misc_feature: COPI gamma

SEQ ID NO: 56 - DNA, 2016 bp, Phyllotreta atra; identical to SEQ ID NO: 52
  misc_feature: COPI gamma

SEQ ID NO: 57 - DNA, 2016 bp, Phyllotreta atra; identical to SEQ ID NO: 52
  misc_feature: COPI gamma

SEQ ID NO: 58 - DNA, 2016 bp, Phyllotreta atra; identical to SEQ ID NO: 52
  misc_feature: COPI gamma

SEQ ID NO: 59 - DNA, 2016 bp, Phyllotreta atra; identical to SEQ ID NO: 52
  misc_feature: COPI gamma

SEQ ID NO: 60 - DNA, 2016 bp, Phyllotreta atra; identical to SEQ ID NO: 52
  misc_feature: COPI gamma

SEQ ID NO: 61 - DNA, 546 bp, Phyllotreta atra
  misc_feature: COPI zeta
aattcactaatggaaggctcgttattggaacccactttgaacgccattaaaggcatagctatcttggataacgatggaaaccgaatattggcaaagtactacgacaaaaacgtatttcccacagcgaaagagcagaagactttcgagaagaatctgttcaacaaaacccacagggcgaacgccgaaattataatgctcgatggccttacgtgcgtgtacaagagtaacgtagatttgtttttctacgtcatgggtagttctcatgaaaatgagttaattctaatgagcgttttaaattgcttatacgattccgtgagccaaattctaaggaagaatatggagaagagggtagttttagattcgttagatatagtcatgttggccatggatgaaatctgcgatggagggattatcatcgatgccgattcgaactcggtggtatcgagggtggctttaagaaacgacgacattccgattggggagcaaacagtcgcccaggtgtttcaatcagccaaagaacagctgaaatggtcattattaaagtaa

SEQ ID NO: 62 - DNA, 546 bp, Phyllotreta atra; identical to SEQ ID NO: 61
  misc_feature: COPI zeta

SEQ ID NO: 63 - DNA, 546 bp, Phyllotreta atra; identical to SEQ ID NO: 61
  misc_feature: COPI zeta

SEQ ID NO: 64 - DNA, 546 bp, Phyllotreta atra; identical to SEQ ID NO: 61
  misc_feature: COPI zeta

SEQ ID NO: 65 - DNA, 546 bp, Phyllotreta atra; identical to SEQ ID NO: 61
  misc_feature: COPI zeta

SEQ ID NO: 66 - DNA, 3987 bp, Phyllotreta atra
  misc_feature: RpL07
atatctaaaatgactctagaggaagaattattaattcacttaaacaacgaggaagaaacgttcacaactaaattgcagtatgtagacaattttttcaagtctaccgaattgcctgtaacatgtaaaattatcctcttaaagtggattttacaacaaaatgaggtcgatttaatatggaaaacactggaaaatttggtgtcttctgcctattttaaaggaatcaatagaaatgaaattgatacgcagagtataaaacaaatcgtagaaggtatcatcgagaaagttacttcacaacctgaagttaaaagggaagaatgttccacagtgactcacctcgtacagcacaaagtattcgaacaatatttcaaattcgatttagaactgtatttcaaattattggacagtattttgatcaagattaacagccaagaataccttttcgaattcctgagcgcaaatttgttttacaaaagtttactgaacaccgaaactttcgttgaaaattttatgagccaaatatttcccactctaaataaatgcgtaaaaaagttcccagacaaaaatgcgtttcttcacctatcacaagtcgttcaaaagtgtttatttcataacaaccagaagaagttcgagcattttgtcaacgaaattttcaaaccagacgatggggagtactttgggttcgatattttactgaagcatcttcaaaaccttatcgaatcgaacaaaaaatcctctgaacattattttaaactgatgtttcacgcgtgtgttgtttcatacggaaacaactctttattgacatacaaatatttcctaattttgatccacattattggatttcggtacgaaataatccctctcaccaacgatttaatttccaacaaccagaaagacagcaaaaaatcgtacaaaatactattagacctactgggcgttttagaagagacgaaattagaaacgaactgtaaaattaacgaaattaacatcaccgaagtgttgaaaacaatcttaaccgaatcgatcattcccaacaaaccgtccaaaacaaattatcaaatcatcgaaaaaatcatccagttagatcctgctataacacaaattgcacaactaactgagcaaattctgaattactccctgctggtagacaattccaaccatattgaccaatacgaagggttgattttaactatattcgagctgttttcgaaactacacagaaccgagaatttaatctctaaaatagttgtaacacttaacaattatttcgataatgtgaacaatggggattgtggagttttggctgttgagaatatttttactaagaagattttggtatcgtttacgaaaaatatacaaactttagccagttggcaggtgataaacgtattcaaaacgttattgaatgctttgatcaagcagctagagaaggaaactagtgaggatgtgtattgcatacatatggagcttctcagcgagttgatttgcacatttttgtccagcataagagtagcagagcacacagtggcttcgaatgtagtagaaaaaactaaaaaatgcctccaggaattgcaagatattttgaaaacgttcggaaaatcgctactaaacaaaacccataattgcagcttaatgaggtcctttttaaaaatagccttccattgggctgaaatggggatcatactgaaatattactcgagccctcaggattctacacagaagaaagctttagaatacaattgtatggctagcaacattacttatttacatccatatttaacacacgaagattggtgttcgatttcagagagaatcaacaacttcggagaagtaccttgcaagcaattattgtacaaattgtacacacagaaagttcgtgcattgtgcatattcgaacaaaaacttaccaacgaagtgttagtggatttatcgaggtatctgacatcagatttggagaataattggaaggatatcctgcaggataaattcttaactaacaatttaatgcatactttagatccggaaagtaggattattttagctgagaaaatcgtgtcgaacatcgatgattttggaaatgtttatcagtatgctcacatatttaacaactcttcgattttgaaagctgtaatttattacacgattacgaaatgcgatagaatattggtgaagaggaaaaggaagtcagatgaaaatttgagcatgtcgaaattaattagcacaaaagtttgcgaatgtttggatgttgttcgattccacgatgaaactattctgaaagattctattagtaaaataagcgaaatatataaatcgaataattcggatggtgaagttaaattcaacgaagagaaaattttggagttggtgaagattttgaaacaatttccggtaatcttctgtgaagcaaatgtgcagaatttcttcattctatattttttttcgctacacaaagaccttagtaattgcttttcaaaaggacaattcgttgaattacgaaaagttttagaggatttaatcgttggtacactacaacagtacaagtacaaattatccaccatattcgccataaaaccgctctgtgtggaaatcctaaacaatttcaacgaatggaaagaactgttcgttctcataatcgaaaatatattcaaatataatgattcaatcgctagttatgattcactcattgagcacattacaaataacttgcgaaatcctgtctacttgcaatgcggaattataattataaatgccgttaacaagttaaaaaaaatgaaggtccccaaagaaatcaaaaaccatacggaaaactacaaatcgtcgatttgcaatggaatttgcgatttagtattaacgagtgaacctaataatcatttagtatgcggatatgcgtacgccttgaaaatattattcgtgcaaaacgaagacgagaagctttcgaagatgctagatgtattgaattcttatgttaatttcgccttggagaagaaggacgatttcgacaaaaccgggtacttattgctgttcaatacagtgttaaacaacaaaactaaaatcaaggaattcgacgatgagctgtacataaaaatttggaatttatgcaaaaacaacgataaagtttttactagaattgaggagtattcgcaattggtgttcctgatggtttgtttgatgtccaacgaacaattcaattgcattattgtagatctagcaattctgtctaatcaggcacttaaagagaataattataaaaattatgtaagcttcctgaaaacgtgggagtccattatcactgctaatatcaaccctgtgaaaaccaatcgtttgcaacgaggagtggaaagtttgctgagcaattcgcttgtacatttagaattatcccaatatgatcaggagttattcgaaaacatcctgcagtttgagatactgctcgtccaaacgaagcactttcatctcacatcgcctacgatggatttgctgatactaagcgtaactactttgctggaaaaggagcctctttcgttcgtttctttttacaatttgctggtttctttgctgtcgaatttgctcaaattcagaaaagctttagtcatggatagattgccgccttatttgcaacaatacagggccttgttgagagtgttgtgtctgaagggggattccaacaaagaacgaaacgagcattttatcagcgatttgtccgattgtgcttaccagttggagaaattaacgaagagtttggtggagcatcagaaggatatggccagaatcgctatgtatttagttgctgatattctggcgcagtatgagagagttacgatttatcccaatatcaaaatgcatctgaacaactgcatttatagtttgataaccatctgtgatcagcacgctgtttcgtgtttaatgagggttttgtccagcgcttccacagaaattttcaaagtaatgtatgagaattataagaaatactacaggttcactggtaaagcttag

SEQ ID NO: 67 - DNA, 3987 bp, Phyllotreta atra; identical to SEQ ID NO: 66
  misc_feature: RpL07

SEQ ID NO: 68 - DNA, 3987 bp, Phyllotreta atra; identical to SEQ ID NO: 66
  misc_feature: RpL07

SEQ ID NO: 69 - DNA, 3987 bp, Phyllotreta atra; identical to SEQ ID NO: 66
  misc_feature: RpL07

SEQ ID NO: 70 - DNA, 3987 bp, Phyllotreta atra; identical to SEQ ID NO: 66
  misc_feature: RpL07

SEQ ID NO: 71 - DNA, 3987 bp, Phyllotreta atra; identical to SEQ ID NO: 66
  misc_feature: RpL07

SEQ ID NO: 72 - DNA, 3987 bp, Phyllotreta atra; identical to SEQ ID NO: 66
  misc_feature: RpL07

SEQ ID NO: 73 - DNA, 3987 bp, Phyllotreta atra; identical to SEQ ID NO: 66
  misc_feature: RpL07

SEQ ID NO: 74 - DNA, 3987 bp, Phyllotreta atra; identical to SEQ ID NO: 66
  misc_feature: RpL07

SEQ ID NO: 75 - DNA, 3987 bp, Phyllotreta atra; identical to SEQ ID NO: 66
  misc_feature: RpL07

SEQ ID NO: 76 - DNA, 3987 bp, Phyllotreta atra; identical to SEQ ID NO: 66
  misc_feature: RpL07

SEQ ID NO: 77 - DNA, 1557 bp, Phyllotreta atra
  misc_feature: Rpn3
caatgtcaacacgccaattgtcatcgttacacagcgaaaaacaatttttcagcaactaattcttgttttccaaatattcgaataaaaatgggcgtagaaaccgacgtcgagatgaaaaacgcagacagcccggcaggcttagaagctggagacagcaagcgtgacatcgacttacaaagcgtcttggaaattcgcgaacatgccaggcagatcgagaaggcagtgagcagcaaagaaaaccgatttatattgagagtgctgcgctgcttgccgaacaccagacgcaaactgaacggaaccgtcctcaggagcctcatcaatcaaatgtaccccgtcgccgagcgggacgtgctgttcggcctcagcgaggagtccgccagtgacgtagacgctacacagtcaagggccagatcagccaccaaaacccctcttcccgaagtggacgcttacattaacttactacttttagtccgactgatcgataccaacaagctggccgaagccgagcgttgctcgaacataatcatgaacaaattcaccagccagaaccgacggactttagaccacatagcagctaaatgctacttctaccattcgagagtggccgaactcaccgacaagctcgactccatcaggggtttcctgcactcccgactgcgcacagccaccctgcgaaacgacttcgaaggccaagccgtgctgattaattgtctgctaagaaattacttgcactactcgctctacgatcaagctgataagttagtgaataaatgcgtctatcccgaaacggctagcaacaacgaatgggccaggtttttgtactatttaggtcgaattaaagctgcacgattggagtacagcgttgcgcataaacacctaattcaagctatgaggaaatcgccccagaatgctgcgatgggcttccgacaaacagtgcaaaagcttaccgttgtagtcgagttgctgttgggggatataccagaaaggcagatcttcaggcaggccagcatgaggcactcgttggccccttacttccagttaacccaggcggttaggatggggaatttgcatagattcggagaagtactggagaactttgggccgcaatttagattggatcatacttttactttaatactacggctgcgtcacaacgttataaaaacagccattagatctatcgggttgtcttactcgagaatatccccgcaagatatagctaagaaactcggcctggattgcgctgaagatgcagaatttatcgttgctaaagctattcgggatggtgtaatcgaggctatcttggatccacaaggggggtatatgagaagcaaggaaagcacagatatttattgcactaaagagccgcaactcgcttttcatcagaggatatcgttttgtttagacctgcataatcagagtgtgaaagctatgagatatcccccgaaggcgtacgggaaagaattggagtctgccgaggagaggcgagaaagggagcaacaagatttggagctagcgaaagaaatggccgaggaagatgatgatggatttccttaa

SEQ ID NO: 78 - DNA, 1600 bp, Phyllotreta atra
  misc_feature: Rpn3
caatgtcaacacgccaattgtcatcgttacacagcgaaaaacaatttttcagcaactaattcttgttttccaaatattcgaataaaaatgggcgtagaaaccgacgtcgagatgaaaaacgcagacagcccggcaggcttagaagctggagacagcaagcgtgacatcgacttacaaagcgtcttggaaattcgcgaacatgccaggcagatcgagaaggcagtgagcagcaaagaaaaccgatttatattgagagtgctgcgctgcttgccgaacaccagacgcaaactgaacggaaccgtcctcaggagcctcatcaatcaaatgtaccccgtcgccgagcgggacgtgctgttcggcctcagcgaggagtccgccagtgacgtagacgctacacagtcaagggccagatcagccaccaaaacccctcttcccgaagtggacgcttacattaacttactacttttagtccgactgatcgataccaacaagctggccgaagccgagcgttgctcgaacataatcatgaacaaattcaccagccagaaccgacggactttagaccacatagcagctaaatgctacttctaccattcgagagtggccgaactcaccgacaagctcgactccatcaggggtttcctgcactcccgactgcgcacagccaccctgcgaaacgacttcgaaggccaagccgtgctgattaattgtctgctaagaaattacttgcactactcgctctacgatcaagctgataagttagtgaataaatgcgtctatcccgaaacggctagcaacaacgaatgggccaggtttttgtactatttaggtcgaattaaagctgcacgattggagtacagcgttgcgcataaacacctaattcaagctatgaggaaatcgccccagaatgctgcgatgggcttccgacaaacagtgcaaaagcttaccgttgtagtcgagttgctgttgggggatataccagaaaggcagatcttcaggcaggccagcatgaggcactcgttggccccttacttccagttaacccaggcggttaggatggggaatttgcatagattcggagaagtactggagaactttgggccgcaatttagattggatcatacttttactttaatactacggctgcgtcacaacgttataaaaacagccattagatctatcgggttgtcttactcgagaatatccccgcaagatatagctaagaaactcggcctggattgcgctgaagatgcagaatttatcgttgctaaagctattcgggatggtgtaatcgaggctatcttggatccacaaggggggtatatgagaagcaaggaaagcacagatatttattgcactaaagagccgcaactcgcttttcatcagaggatatcgttttgtttagacctgcataatcagagtgtgaaagctatgagatatcccccgaaggcgtacgggaaagaattggagtctgccgaggagaggcgagaaagggagcaacaagatttggagctagcgaaagaaatggccgaggaagatgatgatggatttccttaaattgtataggaattatgagttttcgaagataggattcaatttt

SEQ ID NO: 79 - DNA, 1600 bp, Phyllotreta atra; identical to SEQ ID NO: 78
  misc_feature: Rpn3

SEQ ID NO: 80 - DNA, 1600 bp, Phyllotreta atra; identical to SEQ ID NO: 78
  misc_feature: Rpn3

SEQ ID NO: 81 - DNA, 1600 bp, Phyllotreta atra; identical to SEQ ID NO: 78
  misc_feature: Rpn3

SEQ ID NO: 82 - DNA, 1600 bp, Phyllotreta atra; identical to SEQ ID NO: 78
  misc_feature: Rpn3

SEQ ID NO: 83 - DNA, 1600 bp, Phyllotreta atra; identical to SEQ ID NO: 78
  misc_feature: Rpn3

SEQ ID NO: 84 - DNA, 1600 bp, Phyllotreta atra; identical to SEQ ID NO: 78
  misc_feature: Rpn3

SEQ ID NO: 85 - DNA, 1600 bp, Phyllotreta atra; identical to SEQ ID NO: 78
  misc_feature: Rpn3

SEQ ID NO: 86 - DNA, 1600 bp, Phyllotreta atra; identical to SEQ ID NO: 78
  misc_feature: Rpn3

SEQ ID NO: 87 - DNA, 1600 bp, Phyllotreta atra; identical to SEQ ID NO: 78
  misc_feature: Rpn3

SEQ ID NO: 88 - DNA, 987 bp, Phyllotreta atra
  misc_feature: Rpn8
ttaattaaaatgccgagtacagaggttacaacgactaaggtgatagtgcacccgctggtgcttctcagcgtagtggaccatttcaatcggatgggcaaaatcggcaatcaaaagcgtgttgtcggtgttctactcggttgctggagggccaaaggagtcttagatgtgtccaacagtttcgcagtccctttcgatgaggacgacaaagacaaatctgtatggttcttggaccacgactacctggaaaacatgtacggcatgtttaagaaagtcaacgctagagaacgcgtcgttggttggtaccacaccggtcctaaattacaccaaaacgacatcgctatcaacgaattagttcgaagatactgccccaattcagtcttggtgattatagatgcgaaacctaaagatctggggcttcctactgaagcataccaagcggtagaagaagtccacgatgatggctcacccacatctaaaacgtttgaacacgtcccgagcgaaataggcgcagaagaagctgaagaagtcggagtagaacatttactaagagatatcaaagacactacagtgggaactttatctcagaggattactaatcagttattaggccttaaagggttgcatttgcaattgaaagatataagagactatttgatgcaagtgtgcgataacaagctgcccatcaaccatcagatcatctatcaattgcaggatattttcaatttgttgcccgatataaatcaggatgcgttcaacaattcgttttatgttaaaaataacgatcaaatgcttgtagtttatttaggagctctcgttcgatctatcgttgcattgcacaacctaatcaacaacaaactcaccaacagagacgcagaagaaggcaaaaaggaggagaaaaaggacaacaaggataaagatagcaaagacaaggataaggaaaaaacggacaaagagaaggaagcgaagaaggacgagaagaaaaaataa

SEQ ID NO: 89 - DNA, 987 bp, Phyllotreta atra; identical to SEQ ID NO: 88
  misc_feature: Rpn8

SEQ ID NO: 90 - DNA, 987 bp, Phyllotreta atra; identical to SEQ ID NO: 88
  misc_feature: Rpn8

SEQ ID NO: 91 - DNA, 987 bp, Phyllotreta atra; identical to SEQ ID NO: 88
  misc_feature: Rpn8

SEQ ID NO: 92 - DNA, 987 bp, Phyllotreta atra; identical to SEQ ID NO: 88
  misc_feature: Rpn8

SEQ ID NO: 93 - DNA, 987 bp, Phyllotreta atra; identical to SEQ ID NO: 88
  misc_feature: Rpn8

SEQ ID NO: 94 - DNA, 987 bp, Phyllotreta atra; identical to SEQ ID NO: 88
  misc_feature: Rpn8

SEQ ID NO: 95 - DNA, 987 bp, Phyllotreta atra; identical to SEQ ID NO: 88
  misc_feature: Rpn8

SEQ ID NO: 96 - DNA, 987 bp, Phyllotreta atra; identical to SEQ ID NO: 88
  misc_feature: Rpn8

SEQ ID NO: 97 - DNA, 987 bp, Phyllotreta atra; identical to SEQ ID NO: 88
  misc_feature: Rpn8

SEQ ID NO: 98 - DNA, 1188 bp, Phyllotreta atra
  misc_feature: Rpn9
gaaatttttgtcttgtcatcacagaaaatggctgcagctgcggtgcaaccgtctaatgttagtgattatcttgctaaacaacaaaaagaaagtccgaaggaattgggctctgagtgggcagaacttgaggagctccataataaaaaattatggcatcaactaaccctcaaattactagtgtttataaagaaaccagaattacagaaagcggacaacctaatccagctgtatcacaattttattcaaacgttcgaaaataaaatcaatcctttgtctttggtcgaaatagcggccattgtcgtcgaacagtacaaggaaccgaaagacgcgatcgctttcctagaaaagactgaacccaaagtgaaaatcaacccggacgcccaaaacctgtgcaaagtcctcgaaggacagatctaccttgataagttaaacgatttagacaccaccaaaaagatcatcgaggaggtcgaagcgacctttgataatgcggacggggttaccccagtacacgggagattttatttactcgcctcgcaatattacagaattcaaggagaccatgcgcaatattatcgcaccgctttgaggtatttgggctgcatagatgtggaatcgttgaagaccgaagtgaaagtgcagcatgcgtttttcttgggcttagcagctttgctgggagagggagtttacaatctcggagagcttctggcccatcctgtattagagtctctgaaggcaaccgagaatgcttggctcatcgagcttttgtacgccttcaattccggaaacataaggaaattcgaagccatgaaaactcagtggtcgtctatagccgatttggccaccgaggaactattcttaagacagaagatatccttattatgtctgatggagatgacatttaacagaccgtcccataacaggcagttaacatttgcggaaatttcaaaagaaacgaggttacctctcaatgaaattgagctgctggtaatgaaggcgctttcacaaggcttagttaaaggggcaattgatcaggttgccagtacggtaaacatgacatgggttcaaccgagagttttagatcgcactcagatctccagtatggtaacaagactcaatgattggtgcaaacatgttaatacaatggagcaattattagaggaaaaagccagtgaaatattaactttgtag

SEQ ID NO: 99 - DNA, 1188 bp, Phyllotreta atra; identical to SEQ ID NO: 98
  misc_feature: Rpn9

SEQ ID NO: 100 - DNA, 1188 bp, Phyllotreta atra; identical to SEQ ID NO: 98
  misc_feature: Rpn9

SEQ ID NO: 101 - DNA, 1188 bp, Phyllotreta atra; identical to SEQ ID NO: 98
  misc_feature: Rpn9

SEQ ID NO: 102 - DNA, 1188 bp, Phyllotreta atra; identical to SEQ ID NO: 98
  misc_feature: Rpn9

SEQ ID NO: 103 - DNA, 1188 bp, Phyllotreta atra; identical to SEQ ID NO: 98
  misc_feature: Rpn9

SEQ ID NO: 104 - DNA, 1188 bp, Phyllotreta atra; identical to SEQ ID NO: 98
  misc_feature: Rpn9

SEQ ID NO: 105 - DNA, 1188 bp, Phyllotreta atra; identical to SEQ ID NO: 98
  misc_feature: Rpn9

SEQ ID NO: 106 - DNA, 594 bp, Phyllotreta atra
  misc_feature: Sar1
caattaatcgaaatgttcatatgggattggttcacgggagtgctgggatacttaggattatggaagaagtccggaaaattgctctttttaggactggacaacgctggtaaaacgaccttattacatatgcttaaagatgatagactggcccagcacttgcccacattgcatccgacctccgaggaattgtccatcggaaacatgaggtttaccacgttcgatctaggaggccattcgcaagcccgaagagtgtggaaggattacttcccagccgtagatgctatcgtatttcttattgacgctaacgacagatcgagattcgtagaaagcaagcaggaattagatgccctgttaacggacgagactctagccaattgccccgtgttgattctaggcaataaaatcgatctgccggacgccgcctctgaggatgaattgcgaaacgtttactcgttgtatggccaaacgaccggtaaaggtaaagtcgctcggtccgatctacccggaaggcctctcgagcttttcatgtgctccatattgaagaggcagggatacggggagggttttcgttggttggcgcagtacattgattaa

SEQ ID NO: 107 - DNA, 594 bp, Phyllotreta atra; identical to SEQ ID NO: 106
  misc_feature: Sar1

SEQ ID NO: 108 - DNA, 594 bp, Phyllotreta atra; identical to SEQ ID NO: 106
  misc_feature: Sar1

SEQ ID NO: 109 - DNA, 594 bp, Phyllotreta atra; identical to SEQ ID NO: 106
  misc_feature: Sar1

SEQ ID NO: 110 - DNA, 594 bp, Phyllotreta atra; identical to SEQ ID NO: 106
  misc_feature: Sar1

SEQ ID NO: 111 - DNA, 1536 bp, Phyllotreta atra
  misc_feature: VATPase B
ttttttgcggtttgtgttagacgtatcgttcttcacgcagagaagatgtcttacccatcgacgttaaacgcaaaacaggccgcacaggagcacgttttggccgtgtccagagacttcgtatcccagccgaggctcacttacaaaacagtgtctggtgtcaacggaccgttggtaatcctcgaagatgtcaaatttccgaaattcaacgaaatcgtccagctcaaactggccgatggcagtctacgatccggtcaagtattggaggtgagcggctccaaagccgtagtacaagtgttcgaaggtacttcgggaatcgacgccaaaaacaccgtgtgcgaattcaccggcgacattctcagaacccccgtgtccgaagacatgctgggcagggtgttcaacggctcaggaaaaccgatcgataaaggacccccgattttggccgaggacttcttggacatccaaggtcaaccgatcaacccttggtcgcgtatctacccggaggagatgatccagaccggtatctccgccatcgatgtgatgaactcgatcgctcgtggccagaagatccccatcttctcggcggccggtctgccccacaacgaaatcgccgcccaaatttgtagacaagccggtcttgtcaaggtgcccggcaagtcggctttggacgatcacgaagacaacttcgccatcgtgttcgccgctatgggagtcaacatggaaacggctcgtttcttcaaacaagatttcgaggagaacggttcgatggagaacgtatgtttgttcttgaatttggccaacgatcctactattgagagaatcatcacgccccgtttggctctaacggctgccgaatttttggcctatcaatgcgagaagcacgtgttggtcatattgactgatatgtcttcgtacgctgaagctttgcgtgaggtatccgccgccagggaagaagtgcccggtagacgtggtttccccggttacatgtacaccgatttggccaccatttacgaacgagccggacgtgtggagggccgcaacggctccatcacccaaatccccatcttgaccatgcccaacgacgatattactcacccgattcccgatttgaccggttatattaccgaaggacagatctacgtcgaccgtcagctgcacaacaggcaaatttacccaccgatcaacgtcttaccgtcgctgtctcgtctcatgaagtccgccatcggcgagggaatgaccaggaaagatcactctgacgtttctaaccagttgtacgcttgctacgccattggtaaggacgtccaggcgatgaaggccgtggtgggagaggaggccctgacgcccgacgatttgctctacctggagttcctgaccaagttcgagaagaacttcatatcgcagggcagctacgagaaccgtacggtgttcgaatcgctggacatcggctggcagttgttgcgtatcttccccaaggaaatgttgaaacgtatcccggccgccacgttggccgaattctacccgagggactcgcgtcactag

SEQ ID NO: 112 - DNA, 1536 bp, Phyllotreta atra; identical to SEQ ID NO: 111
  misc_feature: VATPase B

SEQ ID NO: 113 - DNA, 1536 bp, Phyllotreta atra; identical to SEQ ID NO: 111
  misc_feature: VATPase B

SEQ ID NO: 114 - DNA, 1536 bp, Phyllotreta atra; identical to SEQ ID NO: 111
  misc_feature: VATPase B

SEQ ID NO: 115 - DNA, 1536 bp, Phyllotreta atra; identical to SEQ ID NO: 111
  misc_feature: VATPase B

SEQ ID NO: 116 - DNA, 1536 bp, Phyllotreta atra; identical to SEQ ID NO: 111
  misc_feature: VATPase B

SEQ ID NO: 117 - DNA, 1536 bp, Phyllotreta atra; identical to SEQ ID NO: 111
  misc_feature: VATPase B

SEQ ID NO: 118 - DNA, 1536 bp, Phyllotreta atra; identical to SEQ ID NO: 111
  misc_feature: VATPase B

SEQ ID NO: 119 - DNA, 1536 bp, Phyllotreta atra; identical to SEQ ID NO: 111
  misc_feature: VATPase B

SEQ ID NO: 120 - DNA, 1536 bp, Phyllotreta atra; identical to SEQ ID NO: 111
  misc_feature: VATPase B

SEQ ID NO: 121 - DNA, 2424 bp, Phyllotreta atra
  misc_feature: Vps2
ataaatatcctacaacaacaacaacagcagcagcagcagcaacaacagcagaaccatccgatcggagacgtcaacgatatgaacaacatgaacgtctacgtgatgaaagataacggtatgcccgccaccatgtcgacgtgcgcttgggataagccgttggggccccagttgaggaaagtggagcacgacggtatgctcggaccgtccatggacgccgttaaggctttggaatccgctcattcgccttcgcaaggagtcacgagtcctggcaatgaaaagatgatcggaaaaaccagtccgctgcaagacaaaagcctgctcgacggcagcacgccccctgtaaatacgataatattcgaaaacaccaacttcaaatcggcgcccggttcgcgaaacgccggccgtccggacagtaagccgcgttcaaaattagacgatggctctacagacaattctgtgatttctagttttaataaacccaacatgaacgatctgctgcaagcgaagccggacaaatcggacagcatgccgctgcagctgttcaaggaggactcggccgacatgaaattggactttttcaccgccgatctgcaattcgccgaggacaagagttcgaagaacttcgcctcgaaacccatccatacgatgaccggcggtaacaatacggtcgacagtttggattacaagatcgcgtcggtgaaaaaagtgtgggagacatccgaacaggagaacgacgagaatcagatcgggttctccggcacgcctctggattcgaacgttttcgcccaagggaaggacactccggatgataatcacgaagtgtacagcccgtcgccgagccaaagcgtgtctacgaccaccaacgtttgcaaggtatctggtagcggtcagactgcactatcttccacccatcagacgcacaccggtatagtggccgccggtctcatgggaaacccactgtctccgccgccgatgcagcctgttttgggcgccaatgtgggcatgaatcctcaatacacggccaatcaacacatcggctaccaggcgaatctatcgggcagcacccaatacggcatatccgccatcccctcgcccccgaccgtcccgctggtgtacaattcgacgcagcaaatccaagccgccgcccaatcggccggcctgtacggcgccttccagatcgaccagctgggcggccagggccgctcgcagtactcgcaataccacaactaccacggcctcggccagacggccaacagcccctattcgacgcagaacgtctttttgccgacggcggcgccgccgccgccgccctccgcgcccgagctgtacccgagcatcagcaattaccgcatgagcgccgccggccccttcggccagaaccagcagctgaacaatcccaccacggtgttgatcagctcgacgagcaatagcctgatgtccgcttcggtgaagcccagcagccaaccaatcagcgctatcggaacgaaagcaggcggggtgggacaggcctatcaacagcaatcccagcagggccagcaggtgtatatggcctacgatccgacgattcaggcgaattatctggcctcgagcggcggggttatgcagcgagctcccgttgcgcaggcgcaaaataacgtagtgcctggattgcaaccgtcgtcgtcgttttattcaggatcaacaggcggccaaacgggctactaccagcaacaggcgagctcttcgatcggctcccaaatgcaacagcatcaaggcggctacggcatgcagggcaacgttttcggcacccacaatcaatcgcacgccaacaccggcatgcagaacttcaactcgcactttctgaccacccccatcgtggcggccgccctcaacgctcaagcgcaacaattccgctccggcctgccggccagctacatgaagggcgtcaacagccaccagatcggcgaccaatcgggcaggccgcagcaattgaagagccccagcagccaggaggtgttgtcttcggtcttcaatacaggtcctcagattccctcgccgaaatcgagacagaacaataaacatcccccgccgcaatcgagcccgacggcccaacagaaatataatttgtatcaaggcgtaggcgggccccaaagctctaatatgcaaaggtatccgacgcctattcagagacccgtaaatttccaagtacagcagaattcagcgaatcaaaagcataggaatacatccaacaaaacacccaaccgacagtattatggtaatcagagccaaaacgagaagtctgaggaagggaaaatgaacgacaacaccaacacggcgggaacagtgaaaacggttttgggaacgagctccggttgttcggtggcggctcccgcagagaaaattaaggacagcattaaagaggagcctgctatgttgaaagactaa

SEQ ID NO: 122 - DNA, 2424 bp, Phyllotreta atra; identical to SEQ ID NO: 121
  misc_feature: Vps2

SEQ ID NO: 123 - DNA, 2424 bp, Phyllotreta atra; identical to SEQ ID NO: 121
  misc_feature: Vps2

SEQ ID NO: 124 - DNA, 2424 bp, Phyllotreta atra; identical to SEQ ID NO: 121
  misc_feature: Vps2

SEQ ID NO: 125 - DNA, 2424 bp, Phyllotreta atra; identical to SEQ ID NO: 121
  misc_feature: Vps2

SEQ ID NO: 126 - DNA, 2424 bp, Phyllotreta atra; identical to SEQ ID NO: 121
  misc_feature: Vps2

SEQ ID NO: 127 - DNA, 2424 bp, Phyllotreta atra; identical to SEQ ID NO: 121
  misc_feature: Vps2

SEQ ID NO: 128 - DNA, 2424 bp, Phyllotreta atra; identical to SEQ ID NO: 121
  misc_feature: Vps2

SEQ ID NO: 129 - DNA, 702 bp, Phyllotreta atra
  misc_feature: Vps20
ggagaagcatattttcaaacagactttacgatgggtatcatttttggtaagaagaaaaagccgagtagagtaacagaacaagacaaagctgtattgcaattaaaacagcagagagataaagtaaaacagtaccaaaggagaatagaattatcccttggtaaggacagagagttagctaaaaaactattgaataatggccaaaaggacagggctaaattactgcttaaaaagaaacggtaccaagagcaactcctatcaaagcttgataatcaactgaacaatctagaaaacttggctggtgatattgaattcgcccaagtggaaacacaagtcgtagaaggccttagaacaggcaatgaagcccttaaaaccatcaatgctgctatgaacattgaagatatcgaacgaatattagatgaaacgagagaaggggtagataaacaaaatgaaatcaacgaattacttagcggccaactaacagatgaagatgaggcagctgttgaagaggaattagcagcaataattagcgaagatttgcccacagtgcctatggaacagcctgaagtacaagttaacgaaactgccaaagaagaagaagatgaaggggaagtagtaacggatgaggaggaggaagaaaaggagaaggtcaagaaaccaaaaactaaggaaaaagagaaagagaaggttcctgtattagcttaa

SEQ ID NO: 130 - DNA, 702 bp, Phyllotreta atra; identical to SEQ ID NO: 129
  misc_feature: Vps20

SEQ ID NO: 131 - DNA, 702 bp, Phyllotreta atra; identical to SEQ ID NO: 129
  misc_feature: Vps20

SEQ ID NO: 132 - DNA, 702 bp, Phyllotreta atra; identical to SEQ ID NO: 129
  misc_feature: Vps20

SEQ ID NO: 133 - DNA, 702 bp, Phyllotreta atra; identical to SEQ ID NO: 129
  misc_feature: Vps20

SEQ ID NO: 134 - DNA, 702 bp, Phyllotreta atra; identical to SEQ ID NO: 129
  misc_feature: Vps20

SEQ ID NO: 135 - DNA, 702 bp, Phyllotreta atra; identical to SEQ ID NO: 129
  misc_feature: Vps20

SEQ ID NO: 136 - DNA, 702 bp, Phyllotreta atra; identical to SEQ ID NO: 129
  misc_feature: Vps20

SEQ ID NO: 137 - DNA, 702 bp, Phyllotreta atra; identical to SEQ ID NO: 129
  misc_feature: Vps20

SEQ ID NO: 138 - DNA, 702 bp, Phyllotreta atra; identical to SEQ ID NO: 129
  misc_feature: Vps20

SEQ ID NO: 139 - DNA, 702 bp, Phyllotreta atra; identical to SEQ ID NO: 129
  misc_feature: Vps20

SEQ ID NO: 140 - DNA, 711 bp, Phyllotreta atra
  misc_feature: Vps24
acattagtattttttaaaaacagcaaaaactcgggaaacatgggacttttcgggaaaacgcctgagaggagtccgaaagacttggttacagagtggaaccacaaactgcgcaaggaaggctaccaactggaaaggcaaatacgatccatccagcgagaagaagaaaaagtcaagcgatccctaaaggaagcagccaagaaaaacgacaaggacacctgcctgatattagccaaggaaatcatcaactctcgcaaagccatcaacaagatctacacgtccaaagcccacctcaactccgtaatgctacaaatgaagaaccaattagccactctcagggtgtcgggctcgctgcaaaaatccacggaggtcatgcagacgatgcagaggctcgtacgcgtgccggaggtggcgcagacgatgcaagacatgtccaaagagatgatgaaagccggcatcatcgaggagatgctggacgaaaccatggaggatctcgaggactccgaggagatggaggaagcggcgcaaaccgagatagataaagtgttgttcgagataacggaagggaagatcggggaggcgccgctgccgccgcaggagctggccgagaaggtgactccggtgccggcgacgtcggtggaggagcccgaggaggaggagaacgaagaggagatttcggagatgcagagtcgcttggctgcgctcaaatcgtaa

SEQ ID NO: 141 - DNA, 711 bp, Phyllotreta atra; identical to SEQ ID NO: 140
  misc_feature: Vps24

SEQ ID NO: 142 - DNA, 711 bp, Phyllotreta atra; identical to SEQ ID NO: 140
  misc_feature: Vps24

SEQ ID NO: 143 - DNA, 711 bp, Phyllotreta atra; identical to SEQ ID NO: 140
  misc_feature: Vps24

SEQ ID NO: 144 - DNA, 711 bp, Phyllotreta atra; identical to SEQ ID NO: 140
  misc_feature: Vps24

SEQ ID NO: 145 - DNA, 711 bp, Phyllotreta atra; identical to SEQ ID NO: 140
  misc_feature: Vps24

SEQ ID NO: 146 - DNA, 2172 bp, Phyllotreta atra
  misc_feature: Vps27
aatcacttttctttcagaatgtttcgccacaggaattttgatactttgcttgaaaaagcgactagccatttgttaatggagcaggatttggtatctacgctgcaaatgtgcgacttgattagacaagatgatattcagccgaaatttgctttgaattcattaaagaagaaactcagttcagaaaatcctcatacagctttatatgccctactggttttggaaagcatggtaaaaaattgtggcactgtatttcatgaagaattaacgactaaaccattctgtgatttcctacatgagttgtcgaaaactaccccacacgaaaatgtccgcagtaaacttcttgagttgattcaaacttggaatttcgcattcagaaaaaatcctaagcatggtgctctcaaggaccttatgaatacaatgaaaatggaaggtcgtaagttccctgcgcttcgagaatcggacgcgatgttttcgtccgatacggctccagaatgggctgacggcgacgtttgccacagatgcagagtgcaattcagcgtgctacagagaaaacaccattgcagagcctgcggtcaagtattttgtggacagtgcacttctaaaacgtctactttacccaaatacggaatagaaaaagaggttagagtttgcgacgcttgttttgatgaaattatgaaaccctcatctgcgccgaagtccaggggatcaagcgagaccgatttacctgaagaatatttgaacagctctttggcacaacaaaaacaagatccgcctaaaaaaagcgacgaagaattaagggaagaagaggaattacagttagcattggctttgagccagtctgaagcggaggctaaagaaaaagaaaaaacccgatctacaactactttatattctgcaaaagctgaaccgatgcctgttgagagaccgcaatctccacctcaacaagtagaatcgaatacggagttagccaaatatctaaacagatcttactgggaatctcttaaatccaacgaccaaaacgatcgtcctatgagtccatccgcgccggccacagctcctcttcagaacatcgacggtaaatttaaaactagagaaaacggtttgggcgacaacgatctggaagatttcatgaagactttaaagggtcacgtcgaaattttcattaacagaatgaaaagtaactccagcagagggaggtctatcgcgaatgacactagcgtacaaactttgttcatgaacataacagctatgcattctcgattgcttcattatattcaagagcacgacgacagccgcatccattacgagtgcctacaggataaaatgacccaagtgaaggacgcaagagcggctttggatgctctccgcgaagaacataacgaaaaattgagaagagaagctgaggaacaggagaggatgcgccaaatgcaaatggcgcacaagttggatgttatgaggaaaaagaaacaggaatatcttcaataccaaagacagttggcgctccaaaggattcaagagcaggagagggaaatgcagatgagacaagaacaacagaaacagcagtatatgatgcctcaatatggttatattagctctcctgtgcacggacaaccttttccccctaacgctggacctcctatgagcaactacaacacttatccatttccacaacacatgatgtcgtctcaaaatatgccgaatcaagttgctgtagctgtgacaggaggcccatctgcccatggtcctcctgctggctatcctcaaggttcctcgcacgcgaataacaatcctcaattcgtgggcgtctcggccccgcacatgatggcagcaggattgcccaatatgccgggcaaccaacagggaatgcctcccaatgcaggaataccgcaacaagggatgccgccgcaaaatcaacccaatttgccgccccaacagcagggcatgcagcaacatcaaggcaatattcctccgaatcagggagtaatgttaccaccgcaaggtgtgccgcagcagggtaggatttctttgccgggaaatattcctcaaaatcaagggatgcagaatcagggaatgcctcagtttcaacagcaacagcctggagctcctcctgctagtccacagatcaaatcgaatggggaagcacaaactgctgaattaattagtttcgattag

SEQ ID NO: 147 - DNA, 2172 bp, Phyllotreta atra; identical to SEQ ID NO: 146
  misc_feature: Vps27

SEQ ID NO: 148 - DNA, 2172 bp, Phyllotreta atra; identical to SEQ ID NO: 146
  misc_feature: Vps27

SEQ ID NO: 149 - DNA, 2172 bp, Phyllotreta atra; identical to SEQ ID NO: 146
  misc_feature: Vps27

SEQ ID NO: 150 - DNA, 2172 bp, Phyllotreta atra; identical to SEQ ID NO: 146
  misc_feature: Vps27

SEQ ID NO: 151 - DNA, 2172 bp, Phyllotreta atra; identical to SEQ ID NO: 146
  misc_feature: Vps27

SEQ ID NO: 152 - DNA, 2172 bp, Phyllotreta atra; identical to SEQ ID NO: 146
  misc_feature: Vps27

SEQ ID NO: 153 - DNA, 2172 bp, Phyllotreta atra; identical to SEQ ID NO: 146
  misc_feature: Vps27

SEQ ID NO: 154 - DNA, 2172 bp, Phyllotreta atra; identical to SEQ ID NO: 146
  misc_feature: Vps27

SEQ ID NO: 155 - DNA, 2172 bp, Phyllotreta atra; identical to SEQ ID NO: 146
  misc_feature: Vps27

SEQ ID NO: 156 - DNA, 2172 bp, Phyllotreta atra; identical to SEQ ID NO: 146
  misc_feature: Vps27

SEQ ID NO: 157 - DNA, 645 bp, Phyllotreta atra
  misc_feature: Vps28
tgtagaatgtctgctaatcacgaaaatcgtccagagctttacgaagaagtaaaactgtatcacaatgcaagggaaagggaaaaatacgataatttagcagatctctacgcagttatcaacacattgcaacagcttgaaaaggcatacattagggattgtgttgttgccaaagagtatactggtgcttgtagtaagctactagttcaatacaaagcagcatttagacaagttaatggagatgagtttcctactgttgatgctttcgttaagaaatataggcttgattgcccggctgccctagaaagaattaaggaagacagacctattactattaaagatgataagggaaatactagtagatgtattgctgatattgtgtccctattcattactgtaatggacaaattgagattagatattcgttctatggatcagttacaccctgatgtgagagatttagtcgataccatgaacagattgagcattttgccgtcggattttgagggcaaacaaaagatttcagaatggttggctacattaaatacgatgcaagtatcagatgaattgtcagaatcacagattagacaactactttttgatcttgagagtgcttatgcctctttcaataaaatattgcacaattaa

SEQ ID NO: 158 - DNA, 645 bp, Phyllotreta atra; identical to SEQ ID NO: 157
  misc_feature: Vps28

SEQ ID NO: 159 - DNA, 645 bp, Phyllotreta atra; identical to SEQ ID NO: 157
  misc_feature: Vps28

SEQ ID NO: 160 - DNA, 645 bp, Phyllotreta atra; identical to SEQ ID NO: 157
  misc_feature: Vps28

SEQ ID NO: 161 - DNA, 645 bp, Phyllotreta atra; identical to SEQ ID NO: 157
  misc_feature: Vps28

SEQ ID NO: 162 - DNA, 645 bp, Phyllotreta atra; identical to SEQ ID NO: 157
  misc_feature: Vps28

SEQ ID NO: 163 - DNA, 645 bp, Phyllotreta atra; identical to SEQ ID NO: 157
  misc_feature: Vps28

SEQ ID NO: 164 - DNA, 645 bp, Phyllotreta atra; identical to SEQ ID NO: 157
  misc_feature: Vps28

SEQ ID NO: 165 - DNA, 1065 bp, Phyllotreta atra
  misc_feature: Vatpase D
aaatttcgattttcgatcatgaaggggtgtctgtttaacatcgacaacggttacttggaaggtttatgccgcggtttcaaatgcggcatattgaagcagtccgattacctcaatttagtgcaatgcgaaaccctggaagatttgaagctgcatttacaaggcaccgactacggcacgttcctggccaacgaaccctccccattgtcagtatccaccatcgatgacaaattgagggagaaactggttatcgagttccagcatatgcgtaaccaagccgtagaacccctgtccacattcctggacttcatcacctacagctacatgatcgacaacataattcttctaatcaccggaactttgcatcaaagacctatcggtgagttgattccaaaatgccaccccctcggcagcttcgagcaaatggaagccatccacgtagcggccaccccggcggaattgtacaacgccgtgttagtagacaccccgctagctccgttcttcgtcgactgcatcagcgagcaggatttggacgagatgaacatcgaaatcatcaggaacaccctgtacaaagcctacttggaggctttcttcaccttctgcaaggagatcggaggcaccactgcggacagcatgtgcgaaatcctggccttcgaagccgatagacgtgctatcatcatcaccatcaactccttcggaacggaattgagcaaagacgaccgcgccaagttgtatccgcgttgcggtaaactccagcctgatggtttggctgctctggctagagctgaggattacgagcaggttaaggctgtggccgagtattacgctgagtattccaaattgttcgagggggctggaaacaatccgggagataagacgttggaggacaaattcttcgagcacgaagtgcgtctgaacatcaacgcgttcatgcagcagttccactttggtgtgttctattcctatttgaagctgaaggagcaggagtgcaggaacatcgtttggatcgcagagtgcgtggctcagaagcacagggccaaaatcgataactacattccgatattctag

SEQ ID NO: 166 - DNA, 1065 bp, Phyllotreta atra; identical to SEQ ID NO: 165
  misc_feature: Vatpase D

SEQ ID NO: 167 - DNA, 1065 bp, Phyllotreta atra; identical to SEQ ID NO: 165
  misc_feature: Vatpase D

SEQ ID NO: 168 - DNA, 1065 bp, Phyllotreta atra; identical to SEQ ID NO: 165
  misc_feature: Vatpase D

SEQ ID NO: 169 - DNA, 1065 bp, Phyllotreta atra; identical to SEQ ID NO: 165
  misc_feature: Vatpase D

SEQ ID NO: 170 - DNA, 1065 bp, Phyllotreta atra; identical to SEQ ID NO: 165
  misc_feature: Vatpase D

SEQ ID NO: 171 - DNA, 2592 bp, Phyllotreta atra
  misc_feature: Vps16A
cgaaaaagcgacgaaaaactgaaaatgtcggcggcaatgttgactgcagaatggtttcttttaggaagagattcatattacaggaaattcgaaatctactccatgtcatggcaaagggaggaaatcaatatggaatcgcttactttttccacggcctcatacggtggtcccatagccaccagaaacaatcgacagaaactgatcaaagtacaaggcggtcatcaaccaatcgtttccgtttattccgcatcaggaaaattcatttcctcctttaaatggactaaacgacccatcgtcaaaatgggctggactaatagggaagaattgctgtgcattttggacgacgccaccgtggtcaaacacgacatgttcggtaaatacctgcacgccttcaacgccgtcggcaggcaaaaggacgtcaaagtgacggacgctaaaatcttcactaattgtcacaatttgacgggcgtcgtcgtcatgacgtccgattggaaattctacgctgtcaataacgtcgatgaaccgaaaagtagacggttgtcggagttgcccagatctgctatccagcctactggttgggcgattgtttctgatgacaataggacggagattttggtggctagaagcttggaattgtacaggttgaaacaggacgaagatcgaaccagttcaatgctggaaccggatataacgaacaaatacacatctataatcaaaatgtcggtgtctttaaacgctagacatttggctttttacacggattccggttttttgtggttgggttcgacagatctgagaacgaaatattgcgaaatcgattgcgattttgttttcaaaccgaaacaaatgttatggtgcggtaacgaagccgtggtcatctattgggaaaaagacaatacgttaatgatagtaagcaagcacggtgaaaaattgaaacacttttacgagtcgacggtgcatttaacgccggaagtggacggcgtcaggatactgtcgaatcaacaacacgaattcctgcaaaaagtaccggaagtggtgcaaaagattttccgaataaacagcaccgaaccgggtagttttttgttggaggcttccaagcaattccagaaaggcagccacaaagccaacgaatacgtttgtttggtgaaaaacgatctggaaacggccgttaatcaatgcatcgaagccgtcagttatgaatttgacgttgacgttcaaaaaatcctactgagagctgctcaattcggcaaatgtttcgtgccgacgatgaagtccgacagttacgtcaacatgtgtcgaattttgagggttttgaacaacgttagagacccgaaaatcggaattcccatcaccattactcaattaaatttcacgaaaaccggtcgatcgtcgatcctcgtacgactcatcgccaggaatcactattatctcgccctgaaaatttcggaatatctaaaactaccgcccagggagggctccacgtatgttttggtgcattgggccaaacataaggtcggtcaaagtcgactcgacgaggagacggtcgccagagagatagccgccaaattgggcgaaaagggtagcggcggcggggtgagttttagcgaaatagcggcgacggcgtcggagtgcggcaggaaaaagttggccatcaagcttttagattacgaatcgaaggcgagcgatcaagtgaaattactattggaattgggcgaaaacgtgccggctttggtcaaagccatcgaaagcggcgatacggatttagtttatactgtcatattgaaattgagagaaaacatgcctttaggggactttaagatgaccatcagaaatttccctatcgctcaatcgctgttcataaaatactgtaaagagcacaacgcgcaggctctaagcgaaatttacattcaagaagacgatttttgcgctcaagccgaacttttcatcaaagactcgctggatgttaagaaaaaccacgcgaaagacgcccttttgtcgtcggccttggaggcgtacaaaaaatcccgcaaagacctcaacgccaccatcgtggaggaacacctgcgcttgtgcaggttccaaagggaattggaggatacgctgccggaggcgcgaggtggaaaattcgccggaaaatccgtacaagacacgtgtaaattactattggaattgaacgaaaccaaattggccgaaaagtttcgcaacgatttcaaaattcccgataaaagatattggtgggcgaaaatcgccagtttggccgatcgaaacgattggatcgaattggagaagttctccaaatggaaaaaatccccgatcggctaccatcccttcgtcgacgtttgtttggcgcacgataaaccgcaggaggcgttgaaatatttacacaaagttggcgaggatgtcaaagtcaaatattacatcaaagcgggacgtttagaggaagcagccgaaatagcctatcaacaaagggacgtccaaagtttgttgtacgttcagggaaaatgtcagggaaatcgattttccgacgaaaatcgacgacgattgatggagaaaatcgcccaaatgatcgcccaaatcgaatcgaaaaaataa

SEQ ID NO: 172 - DNA, 2592 bp, Phyllotreta atra; identical to SEQ ID NO: 171
  misc_feature: Vps16A

SEQ ID NO: 173 - DNA, 2592 bp, Phyllotreta atra; identical to SEQ ID NO: 171
  misc_feature: Vps16A

SEQ ID NO: 174 - DNA, 2592 bp, Phyllotreta atra; identical to SEQ ID NO: 171
  misc_feature: Vps16A

SEQ ID NO: 175 - DNA, 2592 bp, Phyllotreta atra; identical to SEQ ID NO: 171
  misc_feature: Vps16A

SEQ ID NO: 176 - DNA, 2592 bp, Phyllotreta atra; identical to SEQ ID NO: 171
  misc_feature: Vps16A

SEQ ID NO: 177 - DNA, 621 bp, Phyllotreta atra
  misc_feature: Vha26
acaacatcatctgatgataacattacaataaattttataaatcgaatactattttatttcgaccgatgtaaatattatacgatcgcacaaaccccaagcaacctaatcggtgaatttcctgttcacgttacgcccgaacagagcgttacggatttgaggcaccaattgctgcgagatcaagtccaatcgcgcctccagcgtgttgttgatcttcactttgttcttcaacgccagcaaatcgatcccccccgtagtctcctgcgacaagtgcgactcgtcgtcgatcttcaggtgcacctccttgcccgttatgtccttgtacttggtctgcacgttgcccagaatcgacttgaccagctccctgtcctgcgggcgcacgcgcaccgttacttctttctcgaacagctggtagagtccttggaggatgaggctttcgatgatgtggccgtacttcccttggtctttggtgacttcgccgagtcgtttgcgggcgtcttccagcacggaccgaacgtggtcctctctcactttcaacaccttcagtctggcctggttcagcatgttggacgattggattttcttctggagttcgacttgtttctctttcttctcgtagtattc

SEQ ID NO: 178 - DNA, 621 bp, Phyllotreta atra; identical to SEQ ID NO: 177
  misc_feature: Vha26

SEQ ID NO: 179 - DNA, 621 bp, Phyllotreta atra; identical to SEQ ID NO: 177
  misc_feature: Vha26

SEQ ID NO: 180 - DNA, 1938 bp, Phyllotreta atra
  misc_feature: Vha68-2
gaaaatcgtcgatttgctgtacttgatagttcagtgggtgaggttgaattagaaacatcacgtctaatcgccctcgttttcagaacatccacaaaaatgtcgaaagtacgtgttggagacgaagaaaaagagagccagtatgggtacgtccatgctgtatctggtccagtcgtcacagcagaaaagatgtccggatctgctatgtacgaattggtacgtgtgggctacttcgaattagtcggtgaaattatccgtttggaaggagatatggcaactattcaggtctacgaagaaacttccggtgtaactgtcggtgatcccgtgttgagatcaggaaaaccgctatccgttgaacttggtcccggtatcatgggttcgattttcgacggtatccaacgtcctttgaaagacatcaacgttttgaccgaaagtatctacatcccgaaaggtatcaacgtacctgcgctatccagaacagcaaaatgggatttcaaccccattaacataaagttgggttctcatttgaccggtggcgatatctacggtatcgttcacgaaaacacgctggtcaagcacaaaatgcttcttccacctaaagccaaaggtaccgttacgtacatcgcagatcctggaaactacacagtagacgaagttgtgctggaaaccgaattcgacggcgaacgttcgaaatacactatgttgcaagtatggccagtccgtcaagccagaccggtcagcgaaaaattgcccgccaatcatcccttactcaccgggcaacgtgttttggacgctcttttcccttgcgtacaaggcggtactacagctattcccggtgccttcggttgcggaaaaaccgtaatttcccaatcgctatccaaatactccaactccgacgtcatcatctacgtaggttgcggagaaagaggtaacgaaatgtctgaagtattgagagatttcccggaactcagcgtggaaatcgacggtcacaccgaatccatcatgaaacgtaccgccttggtggccaacacctccaacatgcccgtggcggcccgtgaggcctccatctacaccggtatcacgttgtccgagtacttccgtgatatgggttacaacgtgtccatgatggccgattcgacctctcgttgggccgaggctttgagagaaatttccggtcgtttggccgagatgcccgccgattccggttacccggcctacttgggggcccgattggcctcgttctacgagcgcgccggtcgcgttaagtgcttgggtaaccccgatagggaaggctctgtttcgatcgtaggagcagtgtcgccgcctggtggtgatttctctgatcccgtcacttctgctactctcggtatcgtgcaagtgttttgggggttggataagaaactcgcccagcgtaagcatttcccgtctgtcgactggctcagttcttactctaaatacctgagagccttagatgatttctatgacaaaaactttgcggaattcataccgctcagaaccaaagttaaggaaattcttcaagaagaagacgatcttacagaaatcgtgcagctggtaggaaaagcttcattggccgaagctgataaaattacattggaaatcgccaagctgttgaaagaagatttcctgcaacagaactcgtactcatcgtacgacagattctgtcccttctacaaaaccgtgggtatgttgaagaacatgattgggatgtacgatatggcgagacacgccgtagagtcgaccgctcaatctgagaacaagatcacgtggacggtgatcagggattcgatgagcaacattctgtaccaattgagcagtatgaagttcaaggatccggtgaaagacggcgaggcgaagatcaaggcggatttcgatcagctgtacgaggatatccagcaggcgttcagaaatctggaggattaa

SEQ ID NO: 181 - DNA, 1938 bp, Phyllotreta atra; identical to SEQ ID NO: 180
  misc_feature: Vha68-2

SEQ ID NO: 182 - DNA, 1938 bp, Phyllotreta atra; identical to SEQ ID NO: 180
  misc_feature: Vha68-2

SEQ ID NO: 183 - DNA, 1938 bp, Phyllotreta atra; identical to SEQ ID NO: 180
  misc_feature: Vha68-2

SEQ ID NO: 184 - DNA, 1938 bp, Phyllotreta atra; identical to SEQ ID NO: 180
  misc_feature: Vha68-2

SEQ ID NO: 185 - DNA, 1938 bp, Phyllotreta atra; identical to SEQ ID NO: 180
  misc_feature: Vha68-2

SEQ ID NO: 186 - DNA, 1938 bp, Phyllotreta atra; identical to SEQ ID NO: 180
  misc_feature: Vha68-2

SEQ ID NO: 187 - DNA, 2733 bp, Phyllotreta atra
  misc_feature: BetaPrime COPI
aaccgcttaaaaatgccacttcggttagacatcaaaagaaagctaacagcccgttctgaccgggtaaaatgcgtggacctacatcccacggagccttggatgctctgttccctatacagcggcaacataaacgtgtggaaccacgaaaaccagcagctcgtcaaaacattcgaagtgtgcgatctaccggtcagagcggccaaattcgtaccgaggaaaaactggatcgttagtggctccgatgacatgcaaatcagagttttcaattacaacactctagatcgcgtgcacgctttcgaagctcactctgattacgtgcgatccattgttgttcatcccacacaaccttacatactgaccagtagcgatgatatgctgataaagctgtggaactgggaaaaagcgtgggcgtgccaacaagtgttcgaagggcacgtgcattacatcatgcaaatttccatcaaccccaaagacaacaatacgttcgccagcgcttctttggaccgaacaataaaagtttggcagttaggcgcctctactgctaatttcacgttggagggtcacgaaaagggcgttaattgcgtcgattactatcacggtggcgataaaccctacctaatatcgggcgccgacgacaggctggttaaaatctgggattaccagaacaaaacgtgcgtacaaacgttagaggggcacggacagaacgtcacggccgtgtgtttccatccggaattaccgatcgctctcaccggcagcgaagacggcacggttcgagtgtggcacgccaacacgcaccgattagagagcagtttgaactacggtttcgaaagagtatggaccattttttgtctgaaaggttccaataacgtggcgctgggttacgacgagggtagcattctggttaaagtcggtagagaagaacccgctgtgagtatggacgccagcggcggtaaaatcatctgggccagacattcggaactacagcaagctaatcttaaagcgttgcccgaaggtgctgaaataagagacggtgaacgcttgccggtttctatcaaagatatgggcgcttgtgatatctacccgcaaactattcagcacaatccgaatggtagatttgtggtcgtttgtggagacggggaatacattatttacaccgccatggcgctcagaaataaagctttcggaagcgcgcaagaattcgtttgggcgcaggattccagcgaatacgccatcagagaatccggttccactataagaatattcaaaaatttcaaagaaaaaaagaatttcaaatccgacttcggagccgaaggtatatacggcggttatcttttgggggtaaaatccgtctcgggattggctttctacgactgggaaacgttggatttggtcagaagaatcgaaatacagccccgttcgatctactggtcggacagcggcaaattggtgtgtttagccaccgaagatagttattttatactctcctacgacgtggaggaggtccacaaggcgaaagaaaacaaccaagtggccgacgacggcgtggagtccgccttcaatcttctaggcgaagtcaacgagaccgttcgaacggggctttgggtgggcgattgtttcatctacaccaacgccgtgaatcgcatcaattacttcgtcggcggcgaattggtgaccatagcgcacctagacgggcctttgtacgtgctcggctacgtcccgaaagacgatagactgtacttagtcgacaaagaattgcgagtcgttagctaccagttgctactttcggtgttggagtatcaaacggccgttatgagaagagatttctcgacggccgaccgagtgttgccttccatacccaaagaacatagaaccagggtggctcatttcttggaaaagcagggtttcaagcagcaagctttggctgttagtaccgaccccgagcacaggttcgaattggccgtggctttggaggatttgaatacggccaaaatgttggcccaggaggctaacaacccgcagaaatggagccaactggccgatttggcggcctccacgaataatctcgtgttggccaaagagtgcatgcagaaagcccaagattacggtggattgttgctcttagctaccagttctggagatgacgaggtagtgaggacattaggcgaagccacggaagccgagggcaagcataacttggcattcttgtcccacttattagtcggtgacttgaacaaatgtctggacattttgataagcaccggtaggcttcccgaagcggcgtttttcgcgagatcttatcttcccgataaaatttcggaggtggtggacctttggagggcccaattgtcgactgtcaatcagaaagccggccaaagtttggccgatcccaaggattacgaaaatctgtttccagggctgcaagaggccatagcggcgcagaaatatttggaacaaaacgaaccgggtttcattcctgccgcttcggctgtcaccgttacaccgaatcacgacagaaatatgatagcggaggttcaagcgaaagtcaaaaattcaggtgcaagttatttcgataatttgctcggcgaaacaccggttgaacaaacgaacaaaccctctgttgataatgaagaagctgatgaggacgatttggatttggatcttgatggagtgaacattgatgaaaatatagatacaacggatatcaatatagatgacgacttgttaagtgattga

SEQ ID NO: 188 - DNA, 2733 bp, Phyllotreta atra; identical to SEQ ID NO: 187
  misc_feature: BetaPrime COPI

SEQ ID NO: 189 - DNA, 2733 bp, Phyllotreta atra; identical to SEQ ID NO: 187
  misc_feature: BetaPrime COPI

SEQ ID NO: 190 - DNA, 2733 bp, Phyllotreta atra; identical to SEQ ID NO: 187
  misc_feature: BetaPrime COPI

SEQ ID NO: 191 - DNA, 2733 bp, Phyllotreta atra; identical to SEQ ID NO: 187
  misc_feature: BetaPrime COPI

SEQ ID NO: 192 - DNA, 2733 bp, Phyllotreta atra; identical to SEQ ID NO: 187
  misc_feature: BetaPrime COPI

SEQ ID NO: 193 - DNA, 2733 bp, Phyllotreta atra; identical to SEQ ID NO: 187
  misc_feature: BetaPrime COPI

SEQ ID NO: 194 - DNA, 2733 bp, Phyllotreta atra; identical to SEQ ID NO: 187
  misc_feature: BetaPrime COPI

SEQ ID NO: 195 - DNA, 1134 bp, Phyllotreta atra
  misc_feature: Act5C
ttcaaaatgtgtgaagaagaagtcgccgctttagtcgtagacaatggctccggtatgtgcaaggccggtttcgccggagacgacgctccgcgcgccgtctttccctccatcgtcggtcgcccaagacatcaaggagtcatggtcggtatgggtcaaaaagattcctacgtaggtgacgaagcccaaagcaaaagaggtatcctcactttgaaataccccatcgaacacggtatcatcaccaactgggatgatatggaaaagatctggcaccacaccttctacaacgaactccgtgtggctccggaagaacaccccgttcttttgaccgaagctcctcttaaccctaaagccaacagggaaaagatgactcaaatcatgtttgaaaccttcaacacccccgctatgtacgtcgccatccaagccgtactttccttgtacgcttccggtcgtaccaccggtatcgttttggactccggtgacggtgtcacccacaccgtacccatctacgaaggttacgctttgcctcacgccatcctccgtttggacttggccggtcgcgatttgaccgactacctcatgaaaatcctcaccgaaagaggttactcattcaccaccaccgctgaaagagaaatcgtccgtgacatcaaggaaaaactctgctatgtcgcattggacttcgaacaggaaatggccaccgccgccgcttccacctcattggaaaagagctacgaattacccgacggtcaagtcatcaccatcggtaacgagagattccgttgtcctgaggctctattccaaccttccttcttgggtatggaatcctgcggtatccacgaaaccgtctacaactccatcatgaagtgtgacgtcgatatccgtaaggacttgtacgccaacaccgtcttgtccggtggtaccaccatgtaccctggtattgctgaccgtatgcaaaaggaaatcaccgccttggcccccagcacgatcaaaatcaagatcatcgctcccccagaaaggaaatactccgtatggatcggtggatccatcttggcttctctttccactttccaacagatgtggatctccaaacaggaatacgacgacggccctggaatcgttcaccgcaagtgcttctaa

SEQ ID NO: 196 - DNA, 1134 bp, Phyllotreta atra; identical to SEQ ID NO: 195
  misc_feature: Act5C

SEQ ID NO: 197 - DNA, 1134 bp, Phyllotreta atra; identical to SEQ ID NO: 195
  misc_feature: Act5C

SEQ ID NO: 198 - DNA, 1134 bp, Phyllotreta atra; identical to SEQ ID NO: 195
  misc_feature: Act5C

SEQ ID NO: 199 - DNA, 1134 bp, Phyllotreta atra; identical to SEQ ID NO: 195
  misc_feature: Act5C

SEQ ID NO: 200 - DNA, 1134 bp, Phyllotreta atra; identical to SEQ ID NO: 195
  misc_feature: Act5C

SEQ ID NO: 201 - DNA, 1134 bp, Phyllotreta atra; identical to SEQ ID NO: 195
  misc_feature: Act5C

SEQ ID NO: 202 - DNA, 1134 bp, Phyllotreta atra; identical to SEQ ID NO: 195
  misc_feature: Act5C

SEQ ID NO: 203 - DNA, 1134 bp, Phyllotreta atra; identical to SEQ ID NO: 195
  misc_feature: Act5C

SEQ ID NO: 204 - DNA, 1134 bp, Phyllotreta atra; identical to SEQ ID NO: 195
  misc_feature: Act5C

SEQ ID NO: 205 - DNA, 684 bp, Phyllotreta atra
  misc_feature: snf7/shrb
ttttcccttatttccattggaaaaatgagtttctttagtaaaatattcggaggaaaggaaaaagacgagggccctacgcccggggaggccatccaaaagctcagggaaaccgaggacatgttatataaaaaacaagagtttttagaaaagaaaatagaggaatacactttagtagccaaaaagaatgcatcgaagaacaaaagagtggcgcttcaagcgctcaaaaagaagaaacgattggaaaaaacgcaactacaaatagatggaactcttacgacgatcgaaatgcaaagagaggccttggaaggagccagcaccaacacagccgtcttagactccatgaggaacgccgctgaggccctccagaaggcccacaaaaacttgaacgtcgatgatgtccacgatatcatggacgacatagctgaacaacacgatattgccaatgagattacaactgctattagtcaacctgtgggcttcgccgacgatttggacgaggacgaattggaaagcgaactggagaaactggaacaagaaggattagaggaagatttactgaaagttccgggtcctactgaattacccgctgtacctacgggggctatcgctaaaccggttaaacctgctgctaaaaaagtggaggatgatgatgacatgaaggaattggaggcttgggcttcgtaa

SEQ ID NO: 206 - DNA, 684 bp, Phyllotreta atra; identical to SEQ ID NO: 205
  misc_feature: snf7/shrb

SEQ ID NO: 207 - DNA, 684 bp, Phyllotreta atra; identical to SEQ ID NO: 205
  misc_feature: snf7/shrb

SEQ ID NO: 208 - DNA, 684 bp, Phyllotreta atra; identical to SEQ ID NO: 205
  misc_feature: snf7/shrb

SEQ ID NO: 209 - DNA, 684 bp, Phyllotreta atra; identical to SEQ ID NO: 205
  misc_feature: snf7/shrb

SEQ ID NO: 210 - DNA, 684 bp, Phyllotreta atra; identical to SEQ ID NO: 205
  misc_feature: snf7/shrb

SEQ ID NO: 211 - DNA, 684 bp, Phyllotreta atra; identical to SEQ ID NO: 205
  misc_feature: snf7/shrb

SEQ ID NO: 212 - DNA, 684 bp, Phyllotreta atra; identical to SEQ ID NO: 205
  misc_feature: snf7/shrb

SEQ ID NO: 213 - DNA, 2592 bp, Phyllotreta atra; identical to SEQ ID NO: 171
  misc_feature: Vps16A

SEQ ID NO: 214 - DNA, 2592 bp, Phyllotreta atra; identical to SEQ ID NO: 171
  misc_feature: Vps16A

SEQ ID NO: 215 - DNA, 2592 bp, Phyllotreta atra; identical to SEQ ID NO: 171
  misc_feature: Vps16A

SEQ ID NO: 216 - DNA, 2592 bp, Phyllotreta atra; identical to SEQ ID NO: 171
  misc_feature: Vps16A

SEQ ID NO: 217 - DNA, 2592 bp, Phyllotreta atra; identical to SEQ ID NO: 171
  misc_feature: Vps16A

SEQ ID NO: 218 - DNA, 3024 bp, Phyllotreta atra
  misc_feature: Rpn2
aggatgaatattacttcggctgcggggattatatcccttttagaagaaccaagaccagaacttaaagtattcgcgttaagaaaactagactccatagtcgacgaattctggccagaaatttcagaagctattgaaaagatagaaattctgcacgaagacaaagtgtttcaacaacaccagttagctgctttagtcgctagtaaagtatactaccatctgggtgcgttcgaagactcgttaacgtacgctttgggagctggtgatctcttcgacgtaaatgctagaacagaatatgttgaaaccactcttgcaaaatgcatcgacttctatacacaacaacgcatcgccttggcagaaggcgcaaccgatgcgaaacctattgattcgagactcgaagcgattgtaaatcgaatgttccaacgttgtttagatgatggtcaaaaccgccaggctatggggctcgccttagagaccaggagaatggacatcttcgaattatctatcacacaagccgaggatattattagcatgctcacctacgctttccaagtggcgatgagcctaattcagaatagggcatttcgtaacaccgttttaagatcgttggttggcttgtatcgcggtttaactacaccggattacgttaacatgtgccaatgtctaattttcttggacgatgcactgccagtcgcagaaattttggataaattagtgtctggtaaagaagagtccgaattgatggcttaccaaatagctttcgatctgtatgagtctgcaacccaacagtttttggaaagagttttggttgcccttagagctactgctcccattccatcgctgttagaggaaaaggtgaaagctaaagctactgaacaatctagtagcacttcggcagaggctagcaaagatccggttagcagcgaaactaaagtcgaggctaaaaaggaagaaaaatctattgagagtttgactgaaagtgaaaaggaacaccaaaagcgaattgaaaaattgcataccatcctatccggcgaagtatcaatagaacttcatcttcaattcctcattagatctaaccacgccgatcttcttattctgaagcaaaccaaagaaacggttcgagttagtatttgccacactgctacagtcatcgctaacgctttcatgcacagcggtactaccagcgaccaatttctaagggataatttggaatggctagctcgagctacgaattgggcgaaacttacagcaacagcgtctctcggcgtcatccaccgtggacacgaacaagaggctttgacactcatgcaaagctatttgccgaaggaagtcgggccgagttccggatattccgaaggcggtggtttatacgctctgggtcttatacacgccaatcacggtgctaatataatcgattatcttctcggtcaattgaaagacgctcagaatgagatggttaggcacggcggttgtttagggcttggtttggctgccatggggacacacaggcaagatgtctacgaacagctgaagttcaatctctatcaagatgatgctaataccggagaggccgctggaattgcgatgggcatggttatgttaggatccagtaattccactacgattatggatatggtagcgtacgcgcaagagagtcaacacgaaaagattcttcgcggtttggctgttggtataagcttcacgatgtacggccgattagaagaagctgataccctaatacaacagcttacttctgataaggatccaatcctgagaagatccggcatgtatacattagctatggcttattgcggcacgggacacaaccaggcgattagaaaattattacacgttgcggtttctgatgtaaacgatgacgtgagaagagcggcagtcacagcgctcggtttcctgttgttcagaacccccgagcaatgtcccagcgtggtgtccctgttagcggaaagctacaacccccacgtacgttacggcgccgccatggcgctgggcatagcctgcgccggcacgggccttcgcgaggccatagccctgctcgagcccatggtgatgttcgatccggtgaacttcgtccggcagggggccctcatcgcctccgcgatgatcctcatccagcagaccgagcagacctgcccgaaggtcagcttcttcaggcagacctactcccaagtcatctccaacaagcacgaagacgtcatggcgaagttcggcgccatcttggcgcaaggtataatcgacgccggtggcaggaacgtgactctatcgttgcaatccagaactggccacactaatatgctggccgttgtcggtacattggtgtttacgcagtattggtattggttccctctgtcacattgtctggctttagcctttaccccgacgtgcgttatagcgttgaacactcaacttaagatgcctaaactggagttcaaatcgaacgcgaagccgagcttgtacgcctacccggcgcccatggaggaaaagaaacgcgaagaaagggagaaagtcaccactgccgtattgagtatagctgccaggcaaaggagaagggatcacgagaggaaacatcgcgatgagaaaatggatgtggacgaagataaagacgataagaagcccgagaaggaggagaaggagaagaaaaccgaagagaagaaagaggagaaaaagtccgatgataagaaaaccgacgataaaaaagcggcgtcgtcgagcgacgacaaaaaagataagaaagatgataaggaggagaagaaaaaggagcccgagcctagtttcgaaatcctgcaaaatcctgccaggaccatgaggcaacagctgaaagtgattacgcttaatgataactcgcaatacgttgcaatgaaggatgtttcgatcggagggattattatggttcgcaatttgaaacctggtgaagaggaattggtggaacccgtagcagcattcggtccaaagggcgatgatgaaaaggaaccagaaccaccagaaccattcgaatggaccgaggattag

SEQ ID NO: 219 - DNA, 3024 bp, Phyllotreta atra; identical to SEQ ID NO: 218
  misc_feature: Rpn2

SEQ ID NO: 220 - DNA, 3024 bp, Phyllotreta atra; identical to SEQ ID NO: 218
  misc_feature: Rpn2

SEQ ID NO: 221 - DNA, 3024 bp, Phyllotreta atra; identical to SEQ ID NO: 218
  misc_feature: Rpn2

SEQ ID NO: 222 - DNA, 3024 bp, Phyllotreta atra; identical to SEQ ID NO: 218
  misc_feature: Rpn2

SEQ ID NO: 223 - DNA, 3024 bp, Phyllotreta atra; identical to SEQ ID NO: 218
  misc_feature: Rpn2

SEQ ID NO: 224 - DNA, 1182 bp, Phyllotreta atra
  misc_feature: Rpt6
aaaccgacgatgactgttatcaataagatggaggtcgacggaggcctgaagggggaaggcttcaggtcgtattacattacgaaaatcgaagaattgcaacttatcgttgccgaaaagagtcaaaaccttcgaagattgcaggcccaaaggaacgaacttaacgccaaagttcgtatgcttagagaagaactgatgttgcttcaagaacaaggaagctacgtaggtgaagtagtaaaaccgatggacaagaagaaagtcctcgtcaaagttcatccggagggaaaatttgtggtcgatatcgataagaatatcgacattaacgatgtcacacccaattgtagagttgctcttcgaaatgaatcttacactttgcacaaaattttaccgaataaggtggatcctttagtgtctcttatgatggtggaaaaagtgccggattccacttacgaaatggtcggtggtctggacaagcaaataaaagaaatcaaagaggtcattgaattgcccgtgaagcatcctgaacttttcgatgccttgggtatcgctcaaccgaagggtgtgcttttatacggtcctccaggaactggaaaaactcttttggccagagcagtggctcatcatacagaatgtacgtttattcgtgtatctggatcggagttggtgcaaaaattcatcggagaaggttccaggatggttagagaacttttcgttatggccagagaacacgcaccttccataattttcatggacgaaatcgattctattggatcttctcgtatcgaatcaggttcgggcggtgattccgaagtccagagaacaatgttggagttgctcaatcaattggacggattcgaagcgacgaaaaacattaaagtcatcatggccaccaacagaatcgatattttagacccggctttgctcagacccggcagaatcgacaggaaaatcgaattcccgccaccgaacgaggaagcccgattggacatcctgaaaattcactctagaaaaatgaatttgaccagaggaatcaatctgaggaaaatcgccgaattgatgccgggcgctagcggtgccgaagtgaagggtgtttgcaccgaggctggtatgtacgcgttaagagagagaagggtgcacgttacccaagaagatttcgaaatggctgtggccaaggtcatgcagaag

SEQ ID NO: 225 - DNA, 1182 bp, Phyllotreta atra; identical to SEQ ID NO: 224
  misc_feature: Rpt6

SEQ ID NO: 226 - DNA, 1182 bp, Phyllotreta atra; identical to SEQ ID NO: 224
  misc_feature: Rpt6

SEQ ID NO: 227 - DNA, 1182 bp, Phyllotreta atra; identical to SEQ ID NO: 224
  misc_feature: Rpt6

SEQ ID NO: 228 - DNA, 1182 bp, Phyllotreta atra; identical to SEQ ID NO: 224
  misc_feature: Rpt6

SEQ ID NO: 229 - DNA, 1182 bp, Phyllotreta atra; identical to SEQ ID NO: 224
  misc_feature: Rpt6

SEQ ID NO: 230 - DNA, 1182 bp, Phyllotreta atra; identical to SEQ ID NO: 224
  misc_feature: Rpt6

SEQ ID NO: 231 - DNA, 1182 bp, Phyllotreta atra; identical to SEQ ID NO: 224
  misc_feature: Rpt6

SEQ ID NO: 232 - DNA, 1182 bp, Phyllotreta atra; identical to SEQ ID NO: 224
  misc_feature: Rpt6

SEQ ID NO: 233 - DNA, 1182 bp, Phyllotreta atra; identical to SEQ ID NO: 224
  misc_feature: Rpt6

SEQ ID NO: 234 - DNA, 1404 bp, Phyllotreta atra
  misc_feature: sec23
ggtcaagttttgaatgacgatttgaaacaacctattagatcccatcatgacatccaaaaagataacgcgaaatacatgaaaaaagctattaaacattacgatactctggctatgagagcggcgactaacggtcattgtattgacatctattcctgcgctcttgatcaaactggtttgatggaaatgaagcaatgcgtcaattctacaggaggtcatatggtgatgggagactcgttcaattcctcgttgttcaaacaaacgttccaaagagtgtttaccagagatcagaaaaacgatttgaaaatggcttttaacggaacattagaagtgaaatgttctcgagaattaaaagtgcaaggaggcattggatcctgtgtatcattaaacgtcaaaagtcaactggtctccgacacagaaatcggcatgggcaacactgtacaatggaaaatgtgtacgcttactccaagcactacgatggccttgttcttcgaagtcgtcaatcagcattctgcaccgattccgcaaggaggaagaggttgcatacaattcattactcagtatcaacactcgagtggtcaaagaagaattagagtgacaacagtggctcgaaactgggctgacgccactactaatatccaccacatcagcgctggttttgatcaagaagcagcagctgtaattatggccagaatggctgtttatagagctgaatcagatgaaagtcccgacgttctgagatgggtcgatagaatgctgattcgattgtgtcaaaaattcggagaatacaataaagacgatgctggttcattcagattgggccaaaactttagcctctatccgcaattcatgtaccatctaaggaggtctcagttcctgcaagttttcaataattctcctgatgaaacgtcgttctatcgacatatgctgatgagagaagatcttactcaatcattgatcatgattcaaccaattttgtacagttacagtttcaacggccctccggagcctgttctattagatacgagttccatacagcccgatagaatactgcttatggacacgtttttccaaattttgatattccacggagagactatagcgcaatggcgaaatttgaagtaccaggatatgcccgaatacgaaaactttaggcaacttttgcaagcgcccgtggacgatgctcaagagatattacaaacgagatttcccatgccgagatatatcgataccgaacaaggaggatcgcaggctagatttttattgtccaaagtcaatccgagtcagactcacaataacatgtattcatatggaggggacgctggcgctccggttttaacagacgatgtatcacttcaagtatttatggatcatttgaaaaaattggcagtttcgtccacggcttaa

SEQ ID NO: 235 - DNA, 1404 bp, Phyllotreta atra; identical to SEQ ID NO: 234
  misc_feature: sec23

SEQ ID NO: 236 - DNA, 1404 bp, Phyllotreta atra; identical to SEQ ID NO: 234
  misc_feature: sec23

SEQ ID NO: 237 - DNA, 1404 bp, Phyllotreta atra; identical to SEQ ID NO: 234
  misc_feature: sec23

SEQ ID NO: 238 - DNA, 1404 bp, Phyllotreta atra; identical to SEQ ID NO: 234
  misc_feature: sec23

SEQ ID NO: 239 - DNA, 1404 bp, Phyllotreta atra; identical to SEQ ID NO: 234
  misc_feature: sec23

SEQ ID NO: 240 - DNA, 1404 bp, Phyllotreta atra; identical to SEQ ID NO: 234
  misc_feature: sec23

SEQ ID NO: 241 - DNA, 1404 bp, Phyllotreta atra; identical to SEQ ID NO: 234
  misc_feature: sec23

SEQ ID NO: 242 - DNA, 1404 bp, Phyllotreta atra; identical to SEQ ID NO: 234
  misc_feature: sec23

SEQ ID NO: 243 - DNA, 1404 bp, Phyllotreta atra; identical to SEQ ID NO: 234
  misc_feature: sec23

SEQ ID NO: 244 - DNA, 1404 bp, Phyllotreta atra; identical to SEQ ID NO: 234
  misc_feature: sec23

SEQ ID NO: 245 - DNA, 2250 bp, Phyllotreta atra
  misc_feature: sec6
ttatcaattaatagaatctacaaaatgactacaaaaaaaattaatatgagagagctggaagctactgctaaagcctcaggaacagccaaagtcattaacacattaaataggccaggccagttagaaaaaatcgaccaaattaagcaaaggtatgttcgaaaaaaagcatctgttgaagcccttctgaaatcggcaatgcaacagcaattggacggggttcgaactggattggtgcagttgcatcgatgtctcgaagaagtttgtgaaatcgatgatagtatgaagaaaatgtctgaattgtttgccgacgtgcctgaactcagcaagaagcttatcgatattagagatgaaaatatgcgtcattcacaatacgtaacagctaaagaaaacctcaagcatatttttactgttccggaaagtgttgagaaaacgaaagcttggattaacgaaggaaaattgcttcatacacatcaatgtttaagggatttagagaactcgagagacgacctactatttgagttacacaaactaccaaatcaatctgtgcatgacaaatcgatgttaaaagcatatttcgccgatgtggaagtactatcgaaattattggagaagcaactaacgttcattttatctagaaccttaaatacagtaagaaaagacccgacagtaatcgtaacagccttgcggatcatagaaagagaagaaaaagcggacgaagaagctttaaagcaacaaaaacaaactggattcattcctccagctcgaccgaagaaatggagagaaatggcttttaaaattttggagaagaccgtgtcatccaaaatcgagggtactcaagttgaagaaagagaggacaataaacattggcttatacgttatttagaactaattagaatgatgatcttagaagatttgagaattgttaaaacactctgtcttccttgttttccaccaagttacaaaatattagacaaatacattcatatgtatcatggtggtctttctgtacatctacaagaaattatacaaaacgggctcaaaggtaacgaatacgttacaatactttcttgggccttgaaaacgtataaatcaaaagacatgttgggccatccagatctaacagcttcaactgaaagtttacctcctttattacctaaagccgtgctagaccatttggaaggagactatttgaaaaatatcgaagggaattacagtgaatggatgcagaacactctcaaatcagaaaaagaggaatggagatcaaatactgaaccgttctcagaatcgtattctcggacaccggcccccattattatatttcaaatgattgatcagaatttgcaagtagccaaaacaataagtgaagaattaacaataaaagtactaaatttaagcatccagcaagtaattatatttgcagatgcttttagagaagcgattatcgaattcaagaataaatattttgaagacaggaaacaagttgtatattttactcaatacatgatcttaattatcaacaatatcctgcaacttgttgaattaggttctcaattggaaaaagaatatgttactaacaacagttcgcatgaacttactaggaattttggagcattaaaagcgacttatattaaaatgagaaacgaggcagtccattatctcttagaagaattatttgtcgactcggaccaacatttcgacaaactgtttacatcacattggttcgcttccaatcctgcggacacaatttatgtaaccatcgaagattacttccaggattacaaccgcttagtggaagcgaattacaaatatttaatcgagcaattaattacctccgtcggtagaaaatacctcacagccatgctgtccaggcgcatatcgtttaaaacttacgaagaatgcacgaaagcagcacaaaaagcgtcggaagaggccaaccgattgaacagattgtttcagacccttagcaaagacatcgaatgcgaaaacccattcgatgccatcattatgctctcggaggtattgaaaagtgatgacgatatgatgtcgtttgagcttcacagagtcgtggaaaaatatcccgatatcacggatgatcatctcctgaggttgctaaatttgagaggcgatctatcaaggtctgaagttagagacaaagttgcgcatatagataaacctaaagttctacacaaaagtacgatttttaggactttgttgtttccaaaacttgtaaatatcaatttgaacttttaa

SEQ ID NO: 246 - DNA, 2250 bp, Phyllotreta atra; identical to SEQ ID NO: 245
  misc_feature: sec6

SEQ ID NO: 247 - DNA, 2250 bp, Phyllotreta atra; identical to SEQ ID NO: 245
  misc_feature: sec6

SEQ ID NO: 248 - DNA, 2250 bp, Phyllotreta atra; identical to SEQ ID NO: 245
  misc_feature: sec6

SEQ ID NO: 249 - DNA, 2250 bp, Phyllotreta atra; identical to SEQ ID NO: 245
  misc_feature: sec6

SEQ ID NO: 250 - DNA, 2250 bp, Phyllotreta atra; identical to SEQ ID NO: 245
  misc_feature: sec6

SEQ ID NO: 251 - DNA, 2250 bp, Phyllotreta atra; identical to SEQ ID NO: 245
  misc_feature: sec6

SEQ ID NO: 252 - DNA, 2250 bp, Phyllotreta atra; identical to SEQ ID NO: 245
  misc_feature: sec6

SEQ ID NO: 253 - DNA, 2250 bp, Phyllotreta atra; identical to SEQ ID NO: 245
  misc_feature: sec6

SEQ ID NO: 254 - DNA, 2250 bp, Phyllotreta atra; identical to SEQ ID NO: 245
  misc_feature: sec6

SEQ ID NO: 255 - DNA, 717 bp, Phyllotreta atra
  misc_feature: Proteasome alpha 2
tcatttgtgaaaatgtcatctgaacgttatagtttttctttaacaactttcagcccttcaggtaaactagtccaaatcgaatatgctttagcggcagtagcggctggtgctccgtcagtaggaataaaagcatcaaatggagtggtaatagccacggaaaacaagcacaaatccattctttacgacgaacacagcgtccacaaagtggaaatgatcacgaagcacatcggaatggtctattccgggatgggacccgactaccgtttgttggtcaagcaagcgcgtaaaatggcccaacagtattacctggtttacaaagaaccaattcctactgttcagctagttcaacgtgtagccactgtgatgcaggaatacactcaatccgggggagttagacccttcggagtgtccctgttgatctgcggatgggacaacaacaggccttacttattccagtgcgatccttccggggcgtatttcgcttggaaagccaccgcaatgggaaagaattacgtcaacgggaagaccttcctcgagaaaaggtatagcgaagagttggaattggatgatgctgtgcacaccgccattttaacgcttaaagaaagtttcgagggccaaatgaccgctgataacatcgaggttggcatatgcgatccacaaggatttaggagattcgatccttctacagtaaaagattttttggcaaatattccttaa

SEQ ID NO: 256 - DNA, 717 bp, Phyllotreta atra; identical to SEQ ID NO: 255
  misc_feature: Proteasome alpha 2

SEQ ID NO: 257 - DNA, 717 bp, Phyllotreta atra; identical to SEQ ID NO: 255
  misc_feature: Proteasome alpha 2

SEQ ID NO: 258 - DNA, 816 bp, Phyllotreta atra
  misc_feature: Proteasome beta 5
attacaagctacaattccgaggattacgagcgactcgcctacgacgagagcctgcagaagtattgcaccaatttcaagaatggcatgaacttagctgttcccccttttcctgatcccagcaacaactttgcaaggttcaccaaagatgataacggccgtgagatcaaaatcaagttcgaccacggtaccaccacattgggattcatgtacaaagggggcgtagtgctcgcagtggattcccgagccactggcggccaattcattggatcacaaactgtagagaaaatcataaaaatcaacagttttctactagctacaatggcaggaggcgcggctgattgcacctactgggaccgagtattagctaaacaatgtaggctgtacgagctgagaaacagggaacgtatctcggtggctgcggcttccaagttaatggccaacatggtttataattacaagggaatgggcttgtccatgggaatgatgctggctggatgggacaaaaggggtcctcaactctactatgtcgattcagaaggtctaaggacagccgggaaagtgttcagcgtaggttcgggttccatttacgctttcggggtgctggattctgggtacaaatgggacttatccgatgaggaagcttatgatttaggtcgtagatcgatttaccacgctactcacagagacgcctattcaggtggtattgttagagtgtaccacatgaaggagactggctgggtgcacatcgatgataatgattgcatggacttgcattacaagtttgtggaggaaaaggagaagatgggtggcgcttga

SEQ ID NO: 259 - DNA, 880 bp, Phyllotreta atra; identical to SEQ ID NO: 2
  misc_feature: Proteasome beta 5

SEQ ID NO: 260 - DNA, 880 bp, Phyllotreta atra; identical to SEQ ID NO: 2
  misc_feature: Proteasome beta 5

SEQ ID NO: 261 - DNA, 880 bp, Phyllotreta atra; identical to SEQ ID NO: 2
  misc_feature: Proteasome beta 5

SEQ ID NO: 262 - DNA, 880 bp, Phyllotreta atra; identical to SEQ ID NO: 2
  misc_feature: Proteasome beta 5

SEQ ID NO: 263 - DNA, 880 bp, Phyllotreta atra; identical to SEQ ID NO: 2
  misc_feature: Proteasome beta 5

SEQ ID NO: 264 - DNA, 880 bp, Phyllotreta atra; identical to SEQ ID NO: 2
  misc_feature: Proteasome beta 5

SEQ ID NO: 265 - DNA, 880 bp, Phyllotreta atra; identical to SEQ ID NO: 2
  misc_feature: Proteasome beta 5

SEQ ID NO: 266 - DNA, 880 bp, Phyllotreta atra; identical to SEQ ID NO: 2
  misc_feature: Proteasome beta 5

SEQ ID NO: 267 - DNA, 606 bp, Phyllotreta atra
  misc_feature: RpL19
aaaatgagttcgttaaaactccagaagaggctcgcagcctctgttatgagatgcggcaaaaagaaggtatggttggatcccaacgaaatcaacgaaatcgccaacacaaattcacgacaaaacatccgcaagctgatcaaagacggtctgatcatcaagaagcccgtggcggtgcactcgcgcgcccgcgtccgcaagaacaccgaagcccgcaggaagggcaggcactgcggtttcggtaaaaggaaaggtacagcgaacgctcgaacaccaagaaaagaattatggattcaacgtatgagggtgctccgtcgtttgttgaagaagtaccgcgaggccaagaaaatcgacaggcatctgtaccattcgctgtacatgaaggcgaagggtaacgtgttcaagaacaagcgcgtcctgatggaatacatccacaagaagaaggccgagaaggcgcgcgccaagatgttggccgaccaggcgaacgccaagagaatgaaggtgaaacgggccagggagagacgcgaagaacgtatcgctacgaagaagcaggaagttttgcagaattaccagcgggaagacgaagctgccgctgctactaaaaaatag

SEQ ID NO: 268 - DNA, 606 bp, Phyllotreta atra; identical to SEQ ID NO: 267
  misc_feature: RpL19

SEQ ID NO: 269 - DNA, 606 bp, Phyllotreta atra; identical to SEQ ID NO: 267
  misc_feature: RpL19

SEQ ID NO: 270 - DNA, 606 bp, Phyllotreta atra; identical to SEQ ID NO: 267
  misc_feature: RpL19

SEQ ID NO: 271 - DNA, 606 bp, Phyllotreta atra; identical to SEQ ID NO: 267
  misc_feature: RpL19

SEQ ID NO: 272 - DNA, 606 bp, Phyllotreta atra; identical to SEQ ID NO: 267
  misc_feature: RpL19

SEQ ID NO: 273 - DNA, 1281 bp, Phyllotreta atra
  misc_feature: RpL3
cgttttactttatctgccatttcatttttcgacgtcaacatgtcgcacaggaagtttagtgcaccccgtcacggatctatgggattctaccccaagaaaagatcccaaaggcaccgtggtaaagtaaaggctttccccaaagatgacccctcgaaacccgtccatttaacagctttcattggctacaaagccggtatgacccacgtgctacgtgaggcagacaggcctggttcgaaaatcaacaagaaggaaatcgtagaggctgtgaccattttggaaacccctccgatgattgtagtaggcgttgtgggttacatcgaaactccacatggcatgagggctttggccaccgtttgggctgaacatttgtctgaagattgccgtagacgtttctacaagaactggtacaagagcaagaagaaggccttcaccaaggcatccaagaaatggaccgacgatttgggtaaaaagtcaattgagcgcgacttgaagaaaatcgtcaaatactgcaaggttgtcagagtcatcgctcacactcagatgaaattgttgaaacaacgccaaaagaaagcccacattatggaaattcaactcaacggcggtaccattgccgacaaagtggcatgggctaaggagcatttggagaagcccattcccgttggcaacgttttcgctcaagatgagatgatcgattgcatcggtgtaaccaaaggtcatggatacaaaggtgttacatctcgttggcatacgaagaaattgccccgcaagacgcacaagggtcttaggaaagtcgcctgtattggagcctggcatccttctcgagtgtcgttcactgtcgctcgtgctggtcaaaagggttaccatcacaggacggagatgaacaagaaaatctacagaatcggcgctggaattcacactaaggacggaaaggtcatcaaaaacaatgctgctaccgattacgatcttagtgagaaaactattacaccgatgggtggtttccctcattacggtgaagttaacaacgacttcgtcatgattaagggttgttgtattggacctaagaagcgcgtcattacactgagaaaatctctcttggttcacactaagcgtattgctttggagaagatcaatttgaaattcatcgatacgtcgtccaaattcggacacggtagattccaaaccgccgccgacaaggctgcgttcatgggaccccttaagaaagatagagttaaggaagaagacaagactgcggctccagctgcagctgctgcttcgagttaa

SEQ ID NO: 274 - DNA, 1281 bp, Phyllotreta atra; identical to SEQ ID NO: 273
  misc_feature: RpL3

SEQ ID NO: 275 - DNA, 1281 bp, Phyllotreta atra; identical to SEQ ID NO: 273
  misc_feature: RpL3

SEQ ID NO: 276 - DNA, 1281 bp, Phyllotreta atra; identical to SEQ ID NO: 273
  misc_feature: RpL3

SEQ ID NO: 277 - DNA, 1281 bp, Phyllotreta atra; identical to SEQ ID NO: 273
  misc_feature: RpL3

SEQ ID NO: 278 - DNA, 1281 bp, Phyllotreta atra; identical to SEQ ID NO: 273
  misc_feature: RpL3

SEQ ID NO: 279 - DNA, 1281 bp, Phyllotreta atra; identical to SEQ ID NO: 273
  misc_feature: RpL3

SEQ ID NO: 280 - DNA, 573 bp, Phyllotreta atra
  misc_feature: RpL40
agaatgcagatcttcgtgaaaaccctgactgggaaaaccatcaccctcgaggtggagccgtccgataccatcgagaacgtgaaagcaaaaattcaagacaaagaggggatcccaccagatcagcaacgtttgatctttgccggcaaacaactggaagatggaagaaccttatctgactacaatattcaaaaagaatctactctacatttagtacttcgtctccgtggagggatgcaaatattcgttaaaacccttactggtaaaactataaccctcgaagttgaaccatctgatactattgagaacgttaaggcgaaaatccaagacaaagaggggattcctccagatcagcaacgtttaatcttcgccggtaaacaactggaagatggcagaacattgtctgactacaatattcaaaaagagtccacactgcatttagttcttcgtctacgtggaggaatgcaaatattcgttaaaactcttactggtaaaacaattactcttgaagttgaaccatctgatactatcgaaaatgttaaggccaaaattcaagacaaagagggaattcctcca

SEQ ID NO: 281 - DNA, 573 bp, Phyllotreta atra; identical to SEQ ID NO: 280
  misc_feature: RpL40

SEQ ID NO: 282 - DNA, 573 bp, Phyllotreta atra; identical to SEQ ID NO: 280
  misc_feature: RpL40

SEQ ID NO: 283 - DNA, 573 bp, Phyllotreta atra; identical to SEQ ID NO: 280
  misc_feature: RpL40

SEQ ID NO: 284 - DNA, 255 bp, Phyllotreta atra
  misc_feature: RpS21
aacatggaaaacgacgctggtgaaaccgtcgacttgtactgcccaaggaaatgctctgctagcaacagaattattcatgctaaggaccacgctagcattcaactcagcgtagccgatgtcgatcctttaaccggaaggatgaccgaaagttccaaaagctacgccctctgcggagctatcaggcgtatgggagaatcggacgattgtattgtgaggttaacgaagaaagatggaatcttagccaaaaacttctaa

SEQ ID NO: 285 - DNA, 591 bp, Phyllotreta atra; identical to SEQ ID NO: 7
  misc_feature: RpS4

SEQ ID NO: 286 - DNA, 591 bp, Phyllotreta atra; identical to SEQ ID NO: 7
  misc_feature: RpS4

SEQ ID NO: 287 - DNA, 591 bp, Phyllotreta atra; identical to SEQ ID NO: 7
  misc_feature: RpS4

SEQ ID NO: 288 - DNA, 591 bp, Phyllotreta atra; identical to SEQ ID NO: 7
  misc_feature: RpS4

SEQ ID NO: 289 - DNA, 591 bp, Phyllotreta atra; identical to SEQ ID NO: 7
  misc_feature: RpS4

SEQ ID NO: 290 - DNA, 591 bp, Phyllotreta atra; identical to SEQ ID NO: 7
  misc_feature: RpS4

SEQ ID NO: 291 - DNA, 591 bp, Phyllotreta atra; identical to SEQ ID NO: 7
  misc_feature: RpS4

SEQ ID NO: 292 - DNA, 591 bp, Phyllotreta atra; identical to SEQ ID NO: 7
  misc_feature: RpS4

SEQ ID NO: 293 - DNA, 3024 bp, Phyllotreta atra; identical to SEQ ID NO: 218
  misc_feature: Rpn2

SEQ ID NO: 294 - DNA, 3024 bp, Phyllotreta atra; identical to SEQ ID NO: 218
  misc_feature: Rpn2

SEQ ID NO: 295 - DNA, 3024 bp, Phyllotreta atra; identical to SEQ ID NO: 218
  misc_feature: Rpn2

SEQ ID NO: 296 - DNA, 3024 bp, Phyllotreta atra; identical to SEQ ID NO: 218
  misc_feature: Rpn2

SEQ ID NO: 297 - DNA, 573 bp, Phyllotreta cruciferae
  misc_feature: ProsAlpha2
agacatttgttgataacttgcaagtaatcatttgtgaaaatgtcatctgaacgttatagtttttctttaacaactttcagcccttcaggtaaactagtccaaatcgaatatgctttagcggcagtggcggctggtgctccttcagtaggaataaaagcatcaaatggagtggtaatagccacagaaaacaagcacaaatccattctttacgacgaacacagcgtccataaagtagaaatgatcacgaagcacatcggaatggtctattccgggatgggacctgactaccgtttgttggtcaagcaagcacgtaaaatggcccaacagtattacctggtttacaaagaaccaattcctactgttcagctagttcaacgtgttgcaactgtaatgcaggaatacactcaatccgggggagttagacccttcggagtgtccctattgatctgcggatgggacaacaacaggccttacttattccagtgcgatccttctggggcgtatttcgcttggaaagccaccgcaatgggaaagaattatgtcaacgggaagacgttcctcgagaaaaggtaa

SEQ ID NO: 298 - DNA, 1001 bp, Phyllotreta cruciferae
  misc_feature: ProsBeta5
atttagccgatttgatttttgtttattcatcgtgcattaaataccaatagtaatttctgtatttaataataaaaattcaagtttaaatcatgagtttagaagcgttatcgggcattacaagctacaattccgaggattacgagcgactcgcctacgacgagagtctgcagaagtattgcaccaatttcaatggcatgaacttggccgttccgccttttcctgatcccagcaataactttgcaagattcaccaaagatgataatggccgtgagatcaaaattaagttcgaccacggtaccaccacattgggattcatgtacaaggggggcgtagtactcgcagtggattcccgagccactggaggccaattcattggatcacaaactgtagaaaaaatcataaaaatcaacagttttttgctagctacaatggcaggaggcgcggctgattgtacgtactgggaccgagtattagctaaacaatgtaggctgtacgaactgagaaacagggaacgtatttcggtggctgcggcttccaagttaatggccaatatggtttataattacaaaggaatgggtttgtccatgggaatgatgttggctggatgggacaaaaggggtcctcaactctactacgtcgattcagaaggtctaaggacagccgggaaagtgttcagcgtaggttcaggttccatttacgctttcggggtgcttgattctggatacaaatgggacttatccgatgaggaagcttatgatttaggtcgtagatcgatttaccacgctactcatagagacgcctattcaggaggtattgttagagtgtaccacatgaaagagactggttgggtgcacatcgatgataatgattgcatggacttgcattacaagtttgtggaggaaaaggagaaaatgggtggcgcttgattaaattaatttgtgaatttatattttttaagaataataaatttcttgcattaatttgtatactttttaataaat

SEQ ID NO: 299 - DNA, 699 bp, Phyllotreta cruciferae
  misc_feature: RpL19
taaaaacgcagccatatttctttttcggatacacgttgttacgagcgtgtgaaaaatgagttcgttaaaactccagaagaggctcgcagcctctgttatgagatgcggcaaaaagaaggtatggttggatcctaacgaaatcaacgaaatcgccaatacaaattcaagacaaaacatccgcaagctgattaaagatggtttgatcatcaagaagcctgtagcagtgcactcacgtgcccgtgtccgcaagaacaccgaagcccgcaggaagggtaggcactgcggttttggtaaaaggaaaggtacagcgaacgctcgaacaccaagaaaagaattatggattcaacgtatgagagtccttcgtcgtttgttgaaaaagtaccgtgaggccaagaaaatcgacagacatctgtaccattcgctgtacatgaaggcaaagggtaacgtattcaagaacaagcgtgtcctgatggaatacatccacaagaagaaggctgagaaggctcgcgccaagatgttggccgaccaggcgaacgccaagagaatgaaggtcaaacgcgccagggaaagacgtgaagaacgtatcgctacgaagaagcaggaagttttgcagaattaccagagggaagacgaagctgccgctgctactaaaaaataggttattcttcttcatttgatcactaataaaaagttaaggta

SEQ ID NO: 300 - DNA, 1334 bp, Phyllotreta cruciferae
  misc_feature: RpL3
cgtcaacatgtcgcacaggaagtttagtgcaccccgtcatggatccatgggattctaccccaagaaaagatcccaaaggcaccgtggaaaagtaaaggctttccccaaggatgatccctcgaaacccgttcatttaacagctttcattggctacaaagccggtatgacccacgtgctacgtgaggcagacaggcctggttcgaaaatcaacaagaaggaaatcgtagaggctgtaaccattttggaaactcctccgatgattgtagtaggtgttgtgggttacatcgaaactccgcatggtatgagagctttggccaccgtttgggctgaacatttgtccgaagattgccgtagacgtttctacaagaactggtacaagagcaagaagaaggctttcaccaaggcgtccaagaaatggaccgatgatttgggtaagaagtccattgagcgcgacttgaagaaaatcgtcaaatactgcaaggttgtcagagtcatcgctcacactcagatgaaattgttgaaacaacgtcaaaagaaagcccatattatggaaattcaactcaacggaggtaccattgccgacaaagtcgcatgggctaaggagcatttggagaagcccattcccgttggcaacgttttcgctcaagatgagatgatcgattgcatcggtgtaaccaaaggtcatggatacaaaggtgttacatctcgttggcatacgaagaaattgccccgcaagacgcacaagggtcttaggaaagtcgcctgtattggagcctggcatccttctcgagtgtcattcactgtcgctcgtgctggtcaaaagggttaccatcacaggacggagatgaacaagaaaatctacagaatcggtgctggaattcacactaaggacggaaaggtcatcaaaaacaatgctgctaccgattacgatcttagtgagaagaccattacaccaatgggtggtttccctcattatggtgaagttaacaatgacttcgtcatgattaagggttgttgtatgggacctaagaagcgtgtcattacactgagaaaatctctcttggttcacactaagcgtattgctttggagaagatcaatttgaaattcatcgatacgtcgtccaaattcggacacggtagattccaaaccgccgccgacaaggctgcgtttatgggacctcttaagaaagatagagttaaggaagaagacaagactgcggccccagctgcagctgctgcttcgagttaatttttatgcaatgtattttattgttgacaatatacattgattcagagtatttatttttgttatatttttatttattgttacccag

SEQ ID NO: 301 - DNA, 353 bp, Phyllotreta cruciferae
  misc_feature: RpL40
caactggaagatggaagaaccttgtctgactacaacattcagaaagagtccacattgcacttagttcttcgtctccgtggtgggatgcaaatattcgttaaaacccttactggtaaaactatcaccctcgaagttgaaccatctgatactattgagaacgtgaaggcgaaaatccaagacaaagagggtattcctccagatcagcaacgtttaattttcgctggcaaacaactggaagatggaagaaccttatctgactacaatattcaaaaagaatctactctacatttagtacttcgtctccgtggagggatgtaaatattcgttaaaactctttaataactaaaacagtg

SEQ ID NO: 302 - DNA, 374 bp, Phyllotreta cruciferae
  misc_feature: RpS21
gcaccctttcttttttgacgttcatccattttcttgtgtgttattttataacaatcatataaaacatggaaaacgacgctggtgaaaccgtcgacttgtactgcccaagaaaatgctctgctagcaacagaattattcatgctaaggaccacgctagcattcaactcagcgtcgccgacgttgatcctttaaccggaagaatgaccgaaagttccaagagctacgctctctgcggagctatcaggcgtatgggagaatcggacgattgtattgtgaggttaacgaagaaagatggaatcctagccaaaaacttctaattcactacttcgttaaagcattcagaaaatgtaatttaaacttttctaataaataaa

SEQ ID NO: 303 - DNA, 872 bp, Phyllotreta cruciferae
  misc_feature: RpS4
tttttttaacacttttcgcaagttttattgaaaataatattaacacatgtttagtgtgtttttgcagctagccttttatccctttcttcggcaatggatagcttcacacctttacctcttggaagagacacaaaagccttagctcctttaccaattacgaatacattatttaacctagtagcaaaggcatgaccgttagcatccttaatatgtacaatatcgaaggatccaggatgacgttccctgttcatgatcgtaccgacacgacccaaatttctacctccggtgatcatacacaagttgttggattcaaacttgatgtaatcgagaattttagacgtagcgatctccaattgaattgtgtcgtttaccttgatgacaggatcagggtaacggattgtacgaccatcgtgggtcaccaaaaacggaattcctttgggaccggtttgaaccctcttaactttgcaaagcttgtatttagcttcttcagcagtaatacggtggatagcaaatcttcctttcacatcatagatgagacggaaaaattcaccagttttttcaatggtgataacatccataaaacctgcggggtagttggagtcggtcctgacttttccatcgactttgattaatctttgcataactattttagttacctcgctgttagtgagagcatacttcagcctgtttcttaagaaaatcaccaagggtaatgattctcggagtttgtgaggaccggtggacgggcggggtgcgaatacacctcccaatttgtccaacatccatgctttcggcgcatttaaacgcttcaagtgctttttaggtccccgagccatcttgactttaaaaatatgaaagacagagcaggcgtg

SEQ ID NO: 304 - DNA, 1166 bp, Phyllotreta cruciferae
  misc_feature: Rpn2
cgtgcgttacggggccgccatggcgctgggcatagcctgcgccggcacgggcctccgcgaggccatagccctgctcgagcccatggtcatgttcgatccggtgaacttcgtccggcagggggctctcatcgcctcagcgatgatcctcatccagcagaccgagcagacctgcccgaaggtcagcttcttcaggcagacctactcccaggtcatctccaacaagcacgaagacgtcatggcgaagttcggcgccattttggcgcaaggtataatcgatgccggtggcaggaacgtgactttatcgctgcaatccagaaccggccacactaacatgctggccgttgtcggtacattggtgttcacgcagtattggtattggttccctctgtcgcattgtctggctttagcttttaccccgacgtgcgttatagcgttgaatactcaactgaagatgcctaaattggagttcaaatcgaacgcgaaaccgagcttgtacgcctacccggcgcccatggaggaaaagaaacgcgaggaaagggagaaagtcaccaccgccgtattgagcatagctgcgaggcaaaggagaagggatcacgagaggaaacatcgcgatgagaaaatggatgtggacgaagataaagacgataagaaaaccgaaaaggaggagaaagagaagaaaaccgaagacaagaaagaggagaaaaagtccgatgataagaaaaccgacgataaaaaagcggcgtcgtcgagcgacgacaaaaaagataagaaagatgataaggaggagaagaaaaaggagcccgagcctagtttcgaaatcttgcaaaatcctgccaggaccatgaggcaacaactgaaagtgattacgcttaatgataactcgcaatacgttgcaatgaaggatgtttctatcggagggattatcatggttcgcaatttgaaacctggcgaagaagaattggtggaacctgtagcagcattcggtccaaagggcgatgatgaaaaggaaccagaaccaccagaaccattcgaatggaccgaggattagagaaattcactagttatttctaaaatctaaatattaaacttggtttttttcattcagcttaagatgttttttttacatacagtgttgaattatttattcatatatttcttgtatgctg

SEQ ID NO: 305 - DNA, 635 bp, Phyllotreta cruciferae
  misc_feature: Rpt6
ctcggcaaacttatttccataattttttaatcgacatattcttctctgaatccttctgcatgaccttggccacagccatttcgaaatcttcttgggttacgtgtacccttctctcccttagggcgtacatgcctgcctcagtacacactcccttcacttcggcaccgctggcacctggcatcaattcggcgattttcctcaaattgatccctctggtcaaattcatttttctcgagtgaattttcaagatgtccaatcgggcttcctcgttcggtggagggaactcgatcttcctgtcaattctgccgggcctgagtaaagcgggatccaaaatgtcgattctgtttgtagccattataactttaatgttcttcgtagcctcaaatccatcgagttgattcagcaactccagcatagttctttgaacttcggaatcgccaccagaacctgattcgatacgagaggatccaatagaatcgatttcatccatgaaaatgatcgaaggggcatgctccctagccattacgaacagttcccttaccatcctagaaccttccccaatgaatttttgcaccaactccgatcctgatactctaataaacgtgcattctgtgtggtgagctacagctctagcc

SEQ ID NO: 306 - DNA, 467 bp, Phyllotreta cruciferae
  misc_feature: sec23
ggccgttgaaactgtaactgtacaaaattggttgaatcatgatcaatgattgagtaagatcttctctcatcaacatatgtctatagaacgacgtttcatcaggagaattattgaaaacttgcaagaactgagacctccttagatggtacatgaattgcggatagaggctaaagttttggcctaatctgaatgaaccagcatcgtctttattgtattctccgaatttttgacacaatcgaatcagcattctatcgacccatctcagaacgtcgggactctcatctgattcagctctataaacagccattctggccataattacagctgctgcttcctgatcaaaaccagcgctgatgtggtggatattagtagtggcatcagcccagtttcgagccactgttgtcactctaattcttctttgaccacttgagtgttgatactgagtaatgaattgtatgcaacctctt

SEQ ID NO: 307 - DNA, 1164 bp, Phyllotreta cruciferae
  misc_feature: shrb
agtacttttaaagctaatcgaattattttttgaacatcacctaagtgcaattacaaaatacattaaatctgtacaaaaagaagttatatattcatttagctaaatgttattaattatttaattaattgtcctgcctaataagtatgtgaatattaaatcctctttattagttcgtaaatcagatataccacattaatatgaaataacaaattaaacaaatactttttgtacagtttattgatacataatcaaatatttataattggagattaaagtatatctgatttgcacttatattacaaaaatagacagtaaatcataattattttaaagttaataaaaaaaatcaaaagagatactttcaggtattcgaaatacgagaaatattcattgtaactctaaacctttaagccaaaaaataagctgttaatagctatgtttttttttttcatttcacttgtgttattaatccatgcgagttcctcttatgaagcccaagcttccaattctttcatgtcatcatcatcctccacttttttagcagcaggtttaacgggcttggcaatagctcctgtaggtacagcaggtagttcagttgggcctggaactttcagcaaatcttcctctaatccttcttgttcgagcttttctagttcgctttctaattcatcctcgtccaaatcatcagcgaagcctaccggctggctaatagcagtagtaatctcgttggcaatgtcatgctgttcagctatgtcatccatgatgtcgtggacatcatcgacattcaagtttttgtgggctttttggagagcttcagctgcattcttcattgaatctaagacggctgtgttggtgctggctccttcgagggcctccctttgcatttcgattgtagtgagtgtgccatcgatttgtaattgagttttttccaatcgttttttctttttgagcgcctgcagcgcgactctcttattctttgatgcattttttttggctactagtgtatattcctctattttcttttctaaaaactcttgttttttatataacatgtcctcggtttccctgagcttttggatggcttcgcctggcgtggggcccacatccttttcttttcctccgaatattttactaaagaaactcattgttcaaatcaaaatgatg

SEQ ID NO: 308 - DNA, 348 bp, Phyllotreta cruciferae
  misc_feature: Vps16A
agggaaatcagtccacgagacctgcaggatcctgttggacatgaaggagaccaagttggccgagaagttcaagaacgacttcaaaattcccgataaaaggtattggtggttgaaaatcaacagcctggccgatcagaacgattggatcgagctggaaaagttttccaaagcgaagaagtcccctatcggatacgctcccttcgtggacgtttgcttgaggcaggacaaacggcaggaggccctcaaatatctgcccaaagtcggcgacgacatcaaagtcaaatactgcatcaaagccgggtgcttggaagaggccgccgacatagcttatcatcaaagggacgtgcg

SEQ ID NO: 309 - DNA, 1043 bp, Phyllotreta cruciferae
  misc_feature: VATP-E
cttattttgacagatcatatgatcgccagtgggagctcccattttgaacgagtttatcctgcaggagaagtgttgggcgtagttcagtcgagaagactctcgtttttcgtttaacaaatacccgaaatcgcatccacgatggctctgagcgacgcagatgtccagaaacagatcaagcacatgatggctttcatcgagcaagaggccaacgagaaggccgaagaaatcgatgccaaagccgaggaggagttcaacatagaaaagggccgtttggtccaacagcagcgcctcaagatcatggaatactacgagaagaaggagaaacaagtcgagctccagaagaaaatccaatcgtccaacatgctgaaccaggccagattgaaggtgttgaaagtgagagaagaccacgtgagggccgtgctagaagacgcccgcaagcgcctcggcgaagtcacccgagaccagggaaagtacggccacatcatcgaaagcctcatccttcaaggactctaccagctgttcgagaaagaagtaacggtcagggtgcgcccgcaggacagggagctggtcaagtcgattctgggcaacgtgcaaaccaagtacaaggacatcacgggcaaagaggtgcacttgaagatcgacgatgagtcgcacttgtcgcaggagaccaccggagggatcgatttgctggcgctgaagaataaagtgaagatcaacaacacgctcgaggcgcgattggatttgatttcgcagcaattggtgccccaaatacgtaacgctttgttcgggcgtaacgtgaacaggaagttcaccgattaggcggtttggtataacatttacatcggtcgaaataaaatagtattcgaaaatgatgtttataggtttattgtattgttatcatcaattgatgtgtaggattaattcgttgctctatattgtatcattccttgtatattttaatattttgtgaaaattgccggttttgttttaatgttttaattgagaaaatattaagaggcgattgtaatacatgtacataggcg

SEQ ID NO: 310 - DNA, 1841 bp, Phyllotreta cruciferae
  misc_feature: VATP-A
gttgcactacacttatctgttctaacaattaactgcgattaataagatacaatacacgatattttattttattaattcacgatatactgtacaagtttttgataaaatagaagtgaacgtacctttttacaacagattgtaaataaaaacgacgaggatgataccaggagggttacacaatcaaaaaaaataactaatactgaatataaatgactttagacacctgttaaaaaaatatgaaaaaaaaaaggaaaaacttaataataataaattggaatgacaggaataattttctttaaatattttataagcactgtaccctcaccaataaaaaactatacaatattcaacaatttacataaaatattttacatatttggtaatatcaaccgtctttgctactaaaaatggctcatcaattaaatgaataaatcgagggacaggtgacttacttttaacttaattatttattgtatttgatattatctctatcttttttttttcatttaaaacttacactgctgaaaaattttaagagaaatcctaacacctgcgacgaattaatcctccagatttctgaacgcctgctggatatcctcgtacaactgatcgaaatccgccttgatcttcgcctcgccatctttcaccggatccttgaacttcatactgctcaattggtacaaaatgttgctcatcgaatccctgatcaccgtccacgtgatcttgttctcagattgagcagtcgactccacggcgtgtctcgccatatcgtacatcccaatcatgttcttcaacatacccacggttttgtagaagggacagaatctatcgtacgatgagtacgagttctgttgcaggaaatcttctttcaacagcttggcgatttccaatgtaatcttatcagcttcagctaatgaagcttttcctaccagctgcacgatttccgtaaggtcgtcttcttcttgaaggatttctttaactttggttcttagcggtataaattcagggaagtttttgtcatagaaatcatccaaagccctcaaatatttagagtatgaactcagccagtcgacagacgggaagtgcttacgttgggcaagcttcttgtccaatccccaaaacacttgaacgataccaagagtagcggaagtgacaggatcagagaaatcaccaccaggcggcgacacggctcctacgatcgaaacagacccttccctatcggggttacccaagcacttaacgcgaccggcgcgctcgtagaaagaggccaatcgggcccccaagtaggccgggtaaccggaatcggcgggcatctcggccaaacgaccggaaatttctctcaacgcctcggcccaacgggacgtggaatcggccatcatcgatacgtggtaacccatgtctctgaagtactcggatagcgtgatacccgtatagatggaggcctcacgggcggccacgggcatgttggaggtgttggccaccagtgcggtacgcttcatgatggattcggtgtggccgtcgatttccacgctcagctcggggaagtcccgcaacacttcggacatttcgttgcctctctcgccgcaacccacgtagatgatgacgtcggagttggagtatttggacagcgattgggagatgacggttttgccgcaaccgaaggcgccgggaatggctgtcgtaccgccttgtacgcaagggaaaagagaatccaatacacgttgaccggtaagcagagggtgattggccggtaatttctcgctgaccggtctggcttgacggactggccatacttgtaacatggtgaatttggatcgttcaccatcgaattctgtctcaag

SEQ ID NO: 311 - DNA, 738 bp, Phyllotreta cruciferae
  misc_feature: COP I beta
gcccaaactcaaagccataccctgacttttggcccgaattctaatgtgaccggcgacgggcgcgtccggcttgttgaacggcttctcgatgctcaaattcgccagggcgtcctccccgaagatcgatttcgcgtacatattggccgccatgaagccgcattgcccgccgagcgccttctctgatgtcaggcacttcatgttagtactcttcagcagatgctccaggtactcgttgagatccgtcagcggcgtattgacggtcaccttattctcccattcgaattcagcccacatcctcataaactccgaatcggtgcacgatgccggaacaatgtaatccataatatcgatgtgtatgtcgttcaaaacgactacattcctgtccgaagcggcgcctgtcacgtcgtacacgatgttaccgaatatgataccattctcggtcgaggccactttcacgttagccttgatattgcagaaatccttcggcgccagaacgaccggctgaggcttctccaccaacttcaaatcgcccagagtcgccaactccagagtacaattctgcagcgtgtcgctcgtttggttcaccaccaacacgtccagcacgatatcgtactgattaacgtgcacatacgcttcggagtaaacaggatccgagaaacccgtcaactgggcgatcttgttcaatttactcgagccgatggtggagtccgattgccccgtcttgccgcccattagggc

SEQ ID NO: 312 - DNA, 1530 bp, Phyllotreta cruciferae
  misc_feature: Act5C
attgtgtgtatatatatatatattgtataaactatgccaaaaatttattaaaaaaaatgttacaatagttattatataatataacataaaatcatattctcgtttcgttttgtcttaaaaattagaaataaaagaggcaggtttttttacttagataggctttatttcaacctgcccggttacaaattaaaatatatttatatataacaaataaggtgttaaaatgatcttgaaatgtctgtctggcagtaaaacaaccacggtcgcataattgatgtaaaatacagtacaaacaacatgatatagtatatataatataggtaagagtagtaaatagcttagaagcacttgcggtgaacgattccagggccggattcgtcgtattcctgtttggagatccacatctgttggaaagtggaaagagaagccaagatggatccaccgatccatacggagtatttcctttctgggggagcaatgatcttgatcttgattgtgctgggggcaagagcggtgatttccttttgcatacggtcagcaataccagggtacatggtggtaccaccggagagtacagtgttggcgtacaagtccttacggatgtcgacgtcgcacttcatgatggagttgtatacggtttcgtggataccgcaggattccatacccaagaaggaaggttggaagagagcctcagggcaacggaatctttcgttaccgatggtgatgacttgaccgtcgggaagttcgtagctcttttcgagggaggtggaggcggcggcggtggccatttcctgttcgaagtcgagggcgacatagcagagtttctccttgatgtcgcggacgatttccctttcagcggtggtggtgaacgagtaacccctttcggtgaggattttcatgaggtagtcggtcaaatcgcgaccggccaagtccaaacggaggatggcgtggggaagagcgtaaccttcgtagatcggtacggtgtgggttacaccgtcaccggagtccaatacaataccggtggtacgaccggaagcgtagagggagagtacggcttggatggcgacgtacatggccggtgtgttgaaggtttcaaacatgatttgggtcatcttttccctgttggctttagggttaagaggagcctcggtcaagaggacggggtgttcttccggagcgacacggagttcgttgtagaaggtgtggtgccagatcttttccatgtcatcccagttggtgatgataccgtgttcgatggggtatttcaaagtgaggatacctcttttgctttgggcctcgtctcctacgtaggagtccttttgtcccataccgaccatcacaccctgatgtcttgggcgaccgacgatcgaggggaagacggcgcgcggggcgtcgtctccggcgaaaccagccttgcacataccggatccattgtcaacgacaagagccgcaacatcgtcgtcacacatgttgtcttctgtggttgatcactgctcactagacagatataaaacacagctaataagcttg

SEQ ID NO: 313 - DNA, 573 bp, Phyllotreta cruciferae; identical to SEQ ID NO: 297
  misc_feature: ProsAlpha2

SEQ ID NO: 314 - DNA, 1001 bp, Phyllotreta cruciferae; identical to SEQ ID NO: 298
  misc_feature: ProsBeta5

SEQ ID NO: 315 - DNA, 699 bp, Phyllotreta cruciferae; identical to SEQ ID NO: 299
  misc_feature: RpL19

SEQ ID NO: 316 - DNA, 1334 bp, Phyllotreta cruciferae; identical to SEQ ID NO: 300
  misc_feature: RpL3

SEQ ID NO: 317 - DNA, 353 bp, Phyllotreta cruciferae; identical to SEQ ID NO: 301
  misc_feature: RpL40

SEQ ID NO: 318 - DNA, 872 bp, Phyllotreta cruciferae; identical to SEQ ID NO: 303
  misc_feature: RpS4

SEQ ID NO: 319 - DNA, 1166 bp, Phyllotreta cruciferae; identical to SEQ ID NO: 304
  misc_feature: Rpn2

SEQ ID NO: 320 - DNA, 635 bp, Phyllotreta cruciferae; identical to SEQ ID NO: 305
  misc_feature: Rpt6

SEQ ID NO: 321 - DNA, 467 bp, Phyllotreta cruciferae; identical to SEQ ID NO: 306
  misc_feature: sec23

SEQ ID NO: 322 - DNA, 1164 bp, Phyllotreta cruciferae; identical to SEQ ID NO: 307
  misc_feature: shrb

SEQ ID NO: 323 - DNA, 1043 bp, Phyllotreta cruciferae; identical to SEQ ID NO: 309
  misc_feature: VATP-E

SEQ ID NO: 324 - DNA, 1841 bp, Phyllotreta cruciferae; identical to SEQ ID NO: 310
  misc_feature: VATP-A

SEQ ID NO: 325 - DNA, 738 bp, Phyllotreta cruciferae; identical to SEQ ID NO: 311
  misc_feature: COPI beta

SEQ ID NO: 326 - DNA, 1530 bp, Phyllotreta cruciferae; identical to SEQ ID NO: 312
  misc_feature: Act5C

SEQ ID NO: 327 - DNA, 333 bp, Phyllotreta cruciferae
  misc_feature: COPI alpha
aacatgttcttcaagctcaaaaactacaaaactgctgcttctttcgccaagaggctgttagaactcggtcctaggcctgaagtagcccagcaagcgaggaaaatattgcaggcttgcgattcgaatcttacagatgatttgcaattgcagtatgacgagcacaatcctttcaacttgtgtgggcactcttatacacctatttataggggaaaggctgaagagaaatgtccattatgcggtacttcttatttacctaaatataaaggggtattgtgtaatatttgcaaagtggcggaagttggaaaggatacgattggattgaggattagcacg

SEQ ID NO: 328 - DNA, 414 bp, Phyllotreta cruciferae
  misc_feature: COPI delta
acgcacggagtgcagcttcaaacgcacccgaatgtcgataaagaactgttcaaattgcgttcagaaattggtttaaaacagccttcgaaaccattcccgctccacactgacgtaggtgtattaaaatggcgattgcaaagtactgacgaagccctggtgcctctgctaataaactgttggccttctgaagcaggagacggcagttgcgatgtgaatattgaatacgaacttgcccacactaacttagaattagtggacgttaacattacaattcctttgccaattggttgctctccaatagtgggtgaatgcgatggttcgtacactcacgaagcaaaaagaaatcatcttgtatggaacctgccggtaattgatgctagcaacaagacgggttctttagaattcaacgcgccc

SEQ ID NO: 329 - DNA, 414 bp, Phyllotreta cruciferae; identical to SEQ ID NO: 328
  misc_feature: COPI delta

SEQ ID NO: 330 - DNA, 414 bp, Phyllotreta cruciferae; identical to SEQ ID NO: 328
  misc_feature: COPI delta

SEQ ID NO: 331 - DNA, 414 bp, Phyllotreta cruciferae; identical to SEQ ID NO: 328
  misc_feature: COPI delta

SEQ ID NO: 332 - DNA, 423 bp, Phyllotreta cruciferae
  misc_feature: COPI epsilon
gccactgtttacgttaacgaaggcaacttggaagccgcttacaaagtgcttcatgcttcggaaaatctggaagcttacgctttcatcatcgatatattattgaagttagatcgggtagatttggctaagaagaagctcaaggaaatgcaggataaagatgatgatgccacgttaacacagctagcgcaagcttgggttaatgttgccattggaggtgataaattgcaagatgcttactacatttatcaagaaatggttgataaatatggctcgacgcctcttctgttgaatgggcaagcagttgcttttataggacaggctaaatatgaggaagctgaagctgctttgcaggaagctatagataaagatgctaattatccggacacactggttaatttgattacacttcaaaggcatatgggg

SEQ ID NO: 333 - DNA, 423 bp, Phyllotreta cruciferae; identical to SEQ ID NO: 332
  misc_feature: COPI epsilon

SEQ ID NO: 334 - DNA, 771 bp, Phyllotreta cruciferae
  misc_feature: COPI gamma
gtctcccgcgaggagaacttcgcggagaaactgtcggccataccgggcatccagcagctgggcccgatcttcaagagctccgaggtggtggagctgaccgaatccgagacggagtacttcgtgcgctgcatcaagcattgcttcgcccaccacgtggtcctgcagttcgattgcctgaacacgctggccgatcaattgctggaggacgtgcgggtggagctggagccgagcgaagggttcgagttgctgtcggtggtgccgtgcaagcagctgcattacaacgagaccaatcacacctacgctattttgaagttccccgacgacgatttgcctagttgcgttggtactttcggggcggtgttgaagtttatcgttaaagattgcgatcccaccactggcattcccgatagcgatgaaggttacaatgatgaatacatactcgaagacttggaaataacgttgggcgatcaaatacagagagtgagcaaggtcaattggggcgccgcttgggaatcggctgctgagggttccgtggaaaaggaggatacgtattctctcagttcgatgaatacgttggatgaagctgtgaaaaatatcgtgcagttccttggattgcaaccggccgaaagaactgataaagtgcccgaaggcaagagcacccacacgcttctactatcaggagtctttagaggaggaatcgatattttggtaagagctaaacttgctttagcggatggtgttacaatgcaactgactgtaagatcacccgat

SEQ ID NO: 335 - DNA, 772 bp, Phyllotreta cruciferae
  misc_feature: COPI gamma
gtctcccgcgaggagaacttcgcggagaaactgtcggccataccgggcatccagcagctgggcccgatcttcaagagctccgaggtggtggagctgaccgaatccgagacggagtacttcgtgcgctgcatcaagcattgcttcgcccaccacgtggtcctgcagttcgattgcctgaacacgctggccgatcaattgctggaggacgtgcgggtggagctggagccgagcgaagggttcgagttgctgtcggtggtgccgtgcaagcagctgcattacaacgagaccaatcacacctacgctattttgaagttccccgacgacgatttgcctagttgcgttggtactttcggggcggtgttgaagtttatcgttaaagattgcgatcccaccactggcattcccgatagcgatgaaggttacaatgatgaatacatactcgaagacttggaaataacgttgggcgatcaaatacagagagtgagcaaggtcaattggggcgccgcttgggaatcggctgctgagggttccgtggaaaaggaggatacgtattctctcagttcgatgaatacgttggatgaagctgtgaaaaatatcgtgcagttccttggattgcaaccggccgaaagaactgataaagtgcccgaaggcaagagcacccacacgcttctactatcaggagtctttagaggaggaatcgatattttggtaagagctaaacttgctttagcggatggtgttacaatgcaactgactgtaagatcacccgatg

SEQ ID NO: 336 - DNA, 772 bp, Phyllotreta cruciferae; identical to SEQ ID NO: 335
  misc_feature: COPI gamma

SEQ ID NO: 337 - DNA, 772 bp, Phyllotreta cruciferae; identical to SEQ ID NO: 335
  misc_feature: COPI gamma

SEQ ID NO: 338 - DNA, 772 bp, Phyllotreta cruciferae; identical to SEQ ID NO: 335
  misc_feature: COPI gamma

SEQ ID NO: 339 - DNA, 772 bp, Phyllotreta cruciferae; identical to SEQ ID NO: 335
  misc_feature: COPI gamma

SEQ ID NO: 340 - DNA, 772 bp, Phyllotreta cruciferae; identical to SEQ ID NO: 335
  misc_feature: COPI gamma

SEQ ID NO: 341 - DNA, 772 bp, Phyllotreta cruciferae; identical to SEQ ID NO: 335
  misc_feature: COPI gamma

SEQ ID NO: 342 - DNA, 772 bp, Phyllotreta cruciferae; identical to SEQ ID NO: 335
  misc_feature: COPI gamma

SEQ ID NO: 343 - DNA, 772 bp, Phyllotreta cruciferae; identical to SEQ ID NO: 335
  misc_feature: COPI gamma

SEQ ID NO: 344 - DNA, 772 bp, Phyllotreta cruciferae; identical to SEQ ID NO: 335
  misc_feature: COPI gamma

SEQ ID NO: 345 - DNA, 546 bp, Phyllotreta cruciferae
  misc_feature: COPI zeta
aattcactaatggaaggctcgttattggaacccactttgaacgccattaaaggcatagctatattggataatgatggaaaccgaatattggcaaagtattacgacaaaaacgtatttcccacagcgaaagagcagaagactttcgagaaaaacctgttcaacaaaacccacagggcgaacgcggaaattataatgcttgatggccttacatgtgtgtacaaaagtaacgtagatttatttttctatgttatgggtagttctcatgaaaatgagttaattctaatgagcgttttaaattgcttatacgattccgtgagtcaaattctaaggaagaatatggaaaagagggtagttttagattcattagatatagtcatgttggccatggatgaaatctgtgatggagggattatcatcgatgccgattccaactcggtcatatcgagagttgctttaagaaacgacgacattccgattggggagcaaacagtcgcccaggtgtttcaatcagccaaagaacagctgaaatggtcattattaaagtaa

SEQ ID NO: 346 - DNA, 546 bp, Phyllotreta cruciferae; identical to SEQ ID NO: 345
  misc_feature: COPI zeta

SEQ ID NO: 347 - DNA, 546 bp, Phyllotreta cruciferae; identical to SEQ ID NO: 345
  misc_feature: COPI zeta

SEQ ID NO: 348 - DNA, 546 bp, Phyllotreta cruciferae; identical to SEQ ID NO: 345
  misc_feature: COPI zeta

SEQ ID NO: 349 - DNA, 546 bp, Phyllotreta cruciferae; identical to SEQ ID NO: 345
  misc_feature: COPI zeta

SEQ ID NO: 350 - DNA, 546 bp, Phyllotreta cruciferae; identical to SEQ ID NO: 345
  misc_feature: COPI zeta

SEQ ID NO: 351 - DNA, 792 bp, Phyllotreta cruciferae
  misc_feature: RpL07
ctcgcaagttctttttctgtcataccgtcaaatatggcaccgacagccgagaagaaaacgaaaacagtgaagggattgcccgcggtccccgagtctgtgctgaagcaccgcaaaaggcgcgaggcttccagagctaagaggctccaatctatcgtgaagagaaaatccgagcacatcaagaagaggaaagatattttcaagagggccgaacaatacattaaagagtacaggctgaaggaacgagatgaaattaggttgatccgccaagctaaaaacaagggaaacttctacgttccagcggaagctaaattagctttcgtaatgcgtattaagggtatcaacaaggttgccccgaaagttcgcaaagtcctccaactgttcaggctgctccaaatcaacaacggagtgttcgtccagctcaacaaggctaccatcaacatgcttagaatatgcgaaccttacattacctggggttaccccaacttgaaatcggtcagggagctgatctacaagagaggtttcgctaaagtgaacggacagagagtgcccattacgagcaatcaaatcatcgaagacagattaggcaaatctggaattatttgcatggaagatttgattcatgaaatttttactgttggacctaagtttaagtacgcctctaacttcttgtggccgtttaagctaaacacacctactggtgggtggcgcaagaagaccaatcactacgttgaaggtggtgactttggtaatagagaagataaaattaacgaacttctcagaagaatggtgtaa

SEQ ID NO: 352 - DNA, 792 bp, Phyllotreta cruciferae; identical to SEQ ID NO: 351
  misc_feature: RpL07

SEQ ID NO: 353 - DNA, 792 bp, Phyllotreta cruciferae; identical to SEQ ID NO: 351
  misc_feature: RpL07

SEQ ID NO: 354 - DNA, 792 bp, Phyllotreta cruciferae; identical to SEQ ID NO: 351
  misc_feature: RpL07

SEQ ID NO: 355 - DNA, 792 bp, Phyllotreta cruciferae; identical to SEQ ID NO: 351
  misc_feature: RpL07

SEQ ID NO: 356 - DNA, 792 bp, Phyllotreta cruciferae; identical to SEQ ID NO: 351
  misc_feature: RpL07

SEQ ID NO: 357 - DNA, 792 bp, Phyllotreta cruciferae; identical to SEQ ID NO: 351
  misc_feature: RpL07

SEQ ID NO: 358 - DNA, 792 bp, Phyllotreta cruciferae; identical to SEQ ID NO: 351
  misc_feature: RpL07

SEQ ID NO: 359 - DNA, 792 bp, Phyllotreta cruciferae; identical to SEQ ID NO: 351
  misc_feature: RpL07

SEQ ID NO: 360 - DNA, 489 bp, Phyllotreta cruciferae
  misc_feature: Rpn3
caacggttcggggaggtgttggagaattttgggccgcaatttagggtagatcatacgtttactttgatcctgcggcttcggcataatgttatcaagacagctattagatcgattggtttgtcttattccaggatatctccgcaggatatagctaagaaattgggcctggattcagcggaggatgcggaattcatcgtagcgaaggccattcgagatggtgttatcgaagctactttggacccacaagggggctacatgaggagtaaagagagtactgatatctactgtactaaagagcctcaattggcctttcatcagaggatatcattttgtttggatttgcacaatcagagcgtgaaagccatgagatacccgccgaatgcgtacggaaaggaactggaatcggctgaggaaagacgggagagggagcagcaggatttggaattggccaaggaaatggctgaagatgatgatgatagttttccttaa

SEQ ID NO: 361 - DNA, 489 bp, Phyllotreta cruciferae; identical to SEQ ID NO: 360
  misc_feature: Rpn3

SEQ ID NO: 362 - DNA, 489 bp, Phyllotreta cruciferae; identical to SEQ ID NO: 360
  misc_feature: Rpn3

SEQ ID NO: 363 - DNA, 489 bp, Phyllotreta cruciferae; identical to SEQ ID NO: 360
  misc_feature: Rpn3

SEQ ID NO: 364 - DNA, 489 bp, Phyllotreta cruciferae; identical to SEQ ID NO: 360
  misc_feature: Rpn3

SEQ ID NO: 365 - DNA, 672 bp, Phyllotreta cruciferae
  misc_feature: Rpn8
attaattcgaagatactgccccaattcagtcttggtgattatagatgcgaaacctaaagatctggggcttcctactgaagcataccaagcggtagaagaggtccatgatgatggctctcctacatctaaaacgtttgaacacgtcccgagcgaaataggcgcagaagaagctgaggaagtcggagtagaacatttactaagagatattaaagacactacagtgggaactttatctcaaaggattactaatcagttattaggccttaaagggttgcatttgcaattgagagatataagagactatttgatgcaagtgtgcgataacaaactgcccatcaatcatcagatcatctatcaattgcaggatattttcaatttgttgcccgatataaatcaagatgcgttcaacaattcgttttatgttaaaaataacgatcaaatgcttgtagtttatttaggggctctcgttcgatctatcgttgcattgcacaacctaatcaacaacaaactcaccaacagagacgcagaagaaggcaaaaaggaagagaaaaaggacaacaaggataaagatagcaaagacaaggataaggaaaaaacggacaaagagaaggaagcgaagaaggacgagaagaaaaaataagtgttttattttctttttgtaactattttcgt

SEQ ID NO: 366 - DNA, 672 bp, Phyllotreta cruciferae; identical to SEQ ID NO: 365
  misc_feature: Rpn8

SEQ ID NO: 367 - DNA, 672 bp, Phyllotreta cruciferae; identical to SEQ ID NO: 365
  misc_feature: Rpn8

SEQ ID NO: 368 - DNA, 672 bp, Phyllotreta cruciferae; identical to SEQ ID NO: 365
  misc_feature: Rpn8

SEQ ID NO: 369 - DNA, 672 bp, Phyllotreta cruciferae; identical to SEQ ID NO: 365
  misc_feature: Rpn8

SEQ ID NO: 370 - DNA, 672 bp, Phyllotreta cruciferae; identical to SEQ ID NO: 365
  misc_feature: Rpn8

SEQ ID NO: 371 - DNA, 672 bp, Phyllotreta cruciferae; identical to SEQ ID NO: 365
  misc_feature: Rpn8

SEQ ID NO: 372 - DNA, 672 bp, Phyllotreta cruciferae; identical to SEQ ID NO: 365
  misc_feature: Rpn8

SEQ ID NO: 373 - DNA, 672 bp, Phyllotreta cruciferae; identical to SEQ ID NO: 365
  misc_feature: Rpn8

SEQ ID NO: 374 - DNA, 672 bp, Phyllotreta cruciferae; identical to SEQ ID NO: 365
  misc_feature: Rpn8

SEQ ID NO: 375 - DNA, 597 bp, Phyllotreta cruciferae
  misc_feature: Rpn9
cagaaaatggctgcagctgcggtgcaaccgtctaatgttagtgattatcttgctaaacaacaaaaagaaagtccgaaggaattgggctctgagtgggcagaacttgaggagctccataataaaaaattatggcatcaactaaccctcaaattactagtgtttataaagaaaccagaattacagaaagcggacaacctaatccagctgtaccacaattttattcaaacgtttgaaaataaaattaatcctttgtctttggtcgaaatagcggccattgtcgtcgaacagtacaaggaaccgaaagacgcgatcgctttcctagaaaagactgaacccaaagtaaaaatcaacccggatgcccaaaacttgtgcaaagtcctcgaaggacagatctaccttgataagttaaacgatttagacaccaccaaaaagatcatcgaggaggtcgaagcgacctttgataatgcggacggggttactccagtacacgggagattttatttactcgcctcgcaatattacagaattcaaggagaccatgcgcaatattatcgcactgctttgaggtatttgggctgcatagatgtggaatcgttg

SEQ ID NO: 376 - DNA, 597 bp, Phyllotreta cruciferae; identical to SEQ ID NO: 375
  misc_feature: Rpn9

SEQ ID NO: 377 - DNA, 597 bp, Phyllotreta cruciferae; identical to SEQ ID NO: 375
  misc_feature: Rpn9

SEQ ID NO: 378 - DNA, 597 bp, Phyllotreta cruciferae; identical to SEQ ID NO: 375
  misc_feature: Rpn9

SEQ ID NO: 379 - DNA, 597 bp, Phyllotreta cruciferae; identical to SEQ ID NO: 375
  misc_feature: Rpn9

SEQ ID NO: 380 - DNA, 597 bp, Phyllotreta cruciferae; identical to SEQ ID NO: 375
  misc_feature: Rpn9

SEQ ID NO: 381 - DNA, 597 bp, Phyllotreta cruciferae; identical to SEQ ID NO: 375
  misc_feature: Rpn9

SEQ ID NO: 382 - DNA, 597 bp, Phyllotreta cruciferae; identical to SEQ ID NO: 375
  misc_feature: Rpn9

SEQ ID NO: 383 - DNA, 597 bp, Phyllotreta cruciferae; identical to SEQ ID NO: 375
  misc_feature: Rpn9

SEQ ID NO: 384 - DNA, 588 bp, Phyllotreta cruciferae
  misc_feature: Sar1
accgaaatgttcatatgggattggttcacgggagtgctgggctacctaggattatggaagaagtccgggaaattgctgtttttagggctggataacgctggtaaaaccaccttattacacatgcttaaagacgatagattagcccagcacttgcccacgttacatcccacttctgaagaactgtccatcgggaacatgaggtttaccacgttcgatctaggaggccattcgcaggctcgaagagtatggaaggactacttcccagccgtagacgccattgtattccttatcgacgctaacgatagatctcgattcggagaaagcaaacgggagctcgacgcgctgttgacagacgaaaccctggccaactgccccgtgctgattctaggcaataaaatcgatttacccgacgcggcgtctgaggatgagttgagaaacgtttactcgttgtacggccaaacgaccggtaaaggtaaagtcgctcgatcggatctgccggggagaccgttggagctgtttatgtgctcgattctgaagaggcagggctacggggagggttttcgttggctggcgcagtacattgattag

SEQ ID NO: 385 - DNA, 588 bp, Phyllotreta cruciferae; identical to SEQ ID NO: 384
  misc_feature: Sar1

SEQ ID NO: 386 - DNA, 588 bp, Phyllotreta cruciferae; identical to SEQ ID NO: 384
  misc_feature: Sar1

SEQ ID NO: 387 - DNA, 588 bp, Phyllotreta cruciferae; identical to SEQ ID NO: 384
  misc_feature: Sar1

SEQ ID NO: 388 - DNA, 588 bp, Phyllotreta cruciferae; identical to SEQ ID NO: 384
  misc_feature: Sar1

SEQ ID NO: 389 - DNA, 588 bp, Phyllotreta cruciferae; identical to SEQ ID NO: 384
  misc_feature: Sar1

SEQ ID NO: 390 - DNA, 1521 bp, Phyllotreta cruciferae
  misc_feature: VATPase B
gttagacgtatctttcttcacgcagagaagatgtcttacccatcgacgttaaacgcaaaacaggccgcacaggaacacgttttagccgtgtccagagacttcgtatcccagccaaggctcacttacaaaacagtgtctggtgtcaacggaccgttggtaatcctcgaagatgtcaaatttccgaaattcaacgaaatcgtccagctcaaactggccgatggcagtctacgatccggtcaagtattggaggtgagcggctcgaaagccgtagtacaagtgttcgaaggtacttcgggaatcgacgccaaaaacaccgtgtgtgaattcaccggcgacattctcagaacgcccgtgtccgaagacatgttgggcagggtgttcaacggctcaggaaaaccaatcgataaaggacccccaattttggctgaggacttcttggacatccaaggtcaaccgatcaatccttggtcgcgtatctacccggaggaaatgatccaaaccggtatctccgccatcgatgtgatgaactcgatcgctcgtggtcagaagattcccattttctcggcggctggtctgccccacaacgaaatcgccgcccaaatttgtagacaagccggtcttgtcaaggtgcccggcaagtcggctttggacgatcacgaagacaacttcgccatcgtgttcgccgctatgggagtcaacatggaaactgctcgtttcttcaaacaagatttcgaagagaacggttcgatggagaacgtttgtttgttcttgaatttggcgaacgatcctactattgagagaatcatcacgcctcgtttggctctaacagcagccgaatttttggcctatcaatgcgagaaacacgtcttggtcatattgactgatatgtcttcgtacgctgaagctttgcgtgaggtatccgccgccagggaagaagtgcccggtagacgtggtttccccggttacatgtacaccgatttggccaccatttacgaacgagccggacgtgtggagggccgcaacggctccatcacccaaatccccatcttgactatgcccaacgacgatattactcacccgattcccgatttgaccggttatattaccgaaggacagatctacgtcgaccgtcagctgcacaacaggcaaatttaccccccgattaacgtcttaccatcactgtctcgtctcatgaagtccgccatcggcgagggaatgaccaggaaagatcactctgacgtttctaaccagttgtacgcttgctacgccattggtaaggacgttcaggcgatgaaggccgtggtgggagaggaggccctgacgcccgacgatttgctctacctggagttcctgaccaagttcgagaagaacttcatctcgcagggcagctacgagaatcgtacagtgttcgaatcgctggacatcggctggcagttgttgcgtatcttccccaaggaaatgttgaaacgtatcccggccgccacgttggccgaattctacccgagggactcgcgtcattag

SEQ ID NO: 391 - DNA, 2281 bp, Phyllotreta cruciferae
  misc_feature: VATPase B
gttagacgtatctttcttcacgcagagaagatgtcttacccatcgacgttaaacgcaaaacaggccgcacaggaacacgttttagccgtgtccagagacttcgtatcccagccaaggctcacttacaaaacagtgtctggtgtcaacggaccgttggtaatcctcgaagatgtcaaatttccgaaattcaacgaaatcgtccagctcaaactggccgatggcagtctacgatccggtcaagtattggaggtgagcggctcgaaagccgtagtacaagtgttcgaaggtacttcgggaatcgacgccaaaaacaccgtgtgtgaattcaccggcgacattctcagaacgcccgtgtccgaagacatgttgggcagggtgttcaacggctcaggaaaaccaatcgataaaggacccccaattttggctgaggacttcttggacatccaaggtcaaccgatcaatccttggtcgcgtatctacccggaggaaatgatccaaaccggtatctccgccatcgatgtgatgaactcgatcgctcgtggtcagaagattcccattttctcggcggctggtctgccccacaacgaaatcgccgcccaaatttgtagacaagccggtcttgtcaaggtgcccggcaagtcggctttggacgatcacgaagacaacttcgccatcgtgttcgccgctatgggagtcaacatggaaactgctcgtttcttcaaacaagatttcgaagagaacggttcgatggagaacgtttgtttgttcttgaatttggcgaacgatcctactattgagagaatcatcacgcctcgtttggctctaacagcagccgaatttttggcctatcaatgcgagaaacacgtcttggtcatattgactgatatgtcttcgtacgctgaagctttgcgtgaggtatccgccgccagggaagaagtgcccggtagacgtggtttccccggttacatgtacaccgatttggccaccatttacgaacgagccggacgtgtggagggccgcaacggctccatcacccaaatccccatcttgactatgcccaacgacgatattactcacccgattcccgatttgaccggttatattaccgaaggacagatctacgtcgaccgtcagctgcacaacaggcaaatttaccccccgattaacgtcttaccatcactgtctcgtctcatgaagtccgccatcggcgagggaatgaccaggaaagatcactctgacgtttctaaccagttgtacgcttgctacgccattggtaaggacgttcaggcgatgaaggccgtggtgggagaggaggccctgacgcccgacgatttgctctacctggagttcctgaccaagttcgagaagaacttcatctcgcagggcagctacgagaatcgtacagtgttcgaatcgctggacatcggctggcagttgttgcgtatcttccccaaggaaatgttgaaacgtatcccggccgccacgttggccgaattctacccgagggactcgcgtcattagtttcattgttatgtaaaaaaaagaaactttgtatattaatagggagtttgtaaggtttacgaaatgttttatttggaaggtggttttttcgtttgcgaatttattctggcgaacaggcaactatgtggcttttaaatctaaaaactgatttatgtagtgaaagtacttgatttctgaacgaaaaaattatcttctgatattttttgtaaattattaggaaacgcccttccatagggaaagtttattaggtttgttaatgaagtccacttgtaccgattagttgattttaccaaataattttaagccgatgatattgcggtgtaatttttttttgtaaatattatacggcgcctttgagaaaggcgttcaatgtatattaatgcaagttgtcaccctcattttgccgtttgattttatttctattagaaagaatggattatgcaaaaaaaagataaaatgattttaattgtaaaagcaaaatgggttggttacaccatgtgaattaatttcctaatttcaagagtttaaaaagtaccctttccatttatttagatgaaaataagacaatactatttttatcatataagttgatatttaatttttcattgattactctgcacaattgttattacgttcatggtcctgttaaagtggaaattttacattccatatttaaatgtcattgcccttgtataaaagcaatacaaaaagcattgtagcatttcgaagcttttcagtatttttaatctagatggtgaac

SEQ ID NO: 392 - DNA, 2281 bp, Phyllotreta cruciferae; identical to SEQ ID NO: 391
  misc_feature: VATPase B

SEQ ID NO: 393 - DNA, 2281 bp, Phyllotreta cruciferae; identical to SEQ ID NO: 391
  misc_feature: VATPase B

SEQ ID NO: 394 - DNA, 2281 bp, Phyllotreta cruciferae; identical to SEQ ID NO: 391
  misc_feature: VATPase B

SEQ ID NO: 395 - DNA, 2281 bp, Phyllotreta cruciferae; identical to SEQ ID NO: 391
  misc_feature: VATPase B

SEQ ID NO: 396 - DNA, 2281 bp, Phyllotreta cruciferae; identical to SEQ ID NO: 391
  misc_feature: VATPase B

SEQ ID NO: 397 - DNA, 2281 bp, Phyllotreta cruciferae; identical to SEQ ID NO: 391
  misc_feature: VATPase B

SEQ ID NO: 398 - DNA, 2281 bp, Phyllotreta cruciferae; identical to SEQ ID NO: 391
  misc_feature: VATPase B

SEQ ID NO: 399 - DNA, 387 bp, Phyllotreta cruciferae
  misc_feature: Vps2
ttaaaaatggagtggctgttcggtaaaaaagtcacccccgaagaattgcttcgaaaaaatcaaagagcgctaaacaaagccatgcgagatctagacagggaaaaacaaaaaatggaacaacaagagaagaaggttataaacgacattaaaaaattagccaaagaaggtcaaatggacgccgtcaagatcatggccaaggacttggtcaggaccagacgatacgtaaagaaattcatgctaatgaaagccaacatccaagcagtctcgctaaaaatccaaacgctcagatcgcagaacgccatggcgcaagccatgaaaggtgtcaccaaagccatgcagagcatgaacaggcagctcaatttaccccaaatacaacgaatcctgcat

SEQ ID NO: 400 - DNA, 630 bp, Phyllotreta cruciferae
  misc_feature: Vps24
ttggttacagagtggaaccacaaactgcgcaaagaaggctaccaactggaaaggcaaatacgatccatacagcgagaggaagaaaaagtcaagcgatccctaaaggaagcagccaagaaaaacgacaaggacacctgcctaatactcgccaaagaaatcataaactctcgcaaagccatcaacaagatctacacgtccaaagcccacctcaattccgtaatgttgcaaatgaaaaaccaattagccactctcagggtgtcgggctcgctgcaaaaatccacggaggtcatgcagaccatgcagaggctcgtacgggtgccggaggtggcgcagacgatgcaagacatgtccaaagagatgatgaaagccggtatcatcgaggagatgctggacgagaccatggaggatctcgaggactctgaggagatggaggaagcggcgcaaactgagatagataaagtgctattcgagataacggaagggaagattggggaggctccaatgccgccgcaggagcccgccgagaaggtgtctccggtgccggcgacgtcggtggaggagcccgaggaggaggagaacgaagaggagatttcggagatgcaaagtcgcttggctgcgctcaaatcgtaa

SEQ ID NO: 401 - DNA, 630 bp, Phyllotreta cruciferae; identical to SEQ ID NO: 400
  misc_feature: Vps24

SEQ ID NO: 402 - DNA, 630 bp, Phyllotreta cruciferae; identical to SEQ ID NO: 400
  misc_feature: Vps24

SEQ ID NO: 403 - DNA, 630 bp, Phyllotreta cruciferae; identical to SEQ ID NO: 400
  misc_feature: Vps24

SEQ ID NO: 404 - DNA, 630 bp, Phyllotreta cruciferae; identical to SEQ ID NO: 400
  misc_feature: Vps24

SEQ ID NO: 405 - DNA, 630 bp, Phyllotreta cruciferae; identical to SEQ ID NO: 400
  misc_feature: Vps24

SEQ ID NO: 406 - DNA, 630 bp, Phyllotreta cruciferae; identical to SEQ ID NO: 400
  misc_feature: Vps24

SEQ ID NO: 407 - DNA, 453 bp, Phyllotreta cruciferae
  misc_feature: Vps28
tttataatgtctgctaatcacgaaaatcgtccagagctttacgaagaagtaaaactatatcacaatgcaagggaaagggaaaaatacgataatttagcagatctctacgcagttatcaacacattgcaacagcttgaaaaggcgtacattagggattgtgttgttgccaaagaatatactggtgcttgtagtaagctactagttcaatacaaagcagcattcagacaagttaatggagatgagtttcctactgttgatgcttttgttaagaaatataggcttgattgcccggctgccctagaaagaattaaagaagacagacctattactattaaagatgataagggaaatactagtagatgtattgctgatattgtgtccctattcattactgtaatggacaaattgagattagatattcgttccatggatcagttacatcctgatgtgaga

SEQ ID NO: 408 - DNA, 453 bp, Phyllotreta cruciferae; identical to SEQ ID NO: 407
  misc_feature: Vps28

SEQ ID NO: 409 - DNA, 453 bp, Phyllotreta cruciferae; identical to SEQ ID NO: 407
  misc_feature: Vps28

SEQ ID NO: 410 - DNA, 453 bp, Phyllotreta cruciferae; identical to SEQ ID NO: 407
  misc_feature: Vps28

SEQ ID NO: 411 - DNA, 453 bp, Phyllotreta cruciferae; identical to SEQ ID NO: 407
  misc_feature: Vps28

SEQ ID NO: 412 - DNA, 453 bp, Phyllotreta cruciferae; identical to SEQ ID NO: 407
  misc_feature: Vps28

SEQ ID NO: 413 - DNA, 717 bp, Phyllotreta cruciferae
  misc_feature: Vps4
aaatggctgggtgaatccgagaagctggtgaagaatctgttcgaattggcccgagcgcacaagcccagcatcatcttcatcgatgagatcgattcgctctgttcttcacgttccgataacgaatctgagtctgctagaaggatcaaaaccgagtttttggtccaaatgcaaggtgtgggtcacgacaccgaagggattctggtactaggagcaacgaatataccgtgggtattagattctgcgattcgaagacgtttcgaaaagagaatttacataccgctgccggaggagccggccagggctgtaatgtttaaactgcatttgggtaataccagaacggaattgaccgaagaggacattaaagaattagccagcaagacagaagggtattcgggtgcagatataagtatagttgttcgagatgctctcatgcagcctgtacgtaaagtgcaaacagccacgcattttaagaaagttaggggaccttctccgactgatccaaaaacgattgttgacgatttgttgataccgtgttcgccaggtgatcctggtgctatagaaatgtcctggatggatataccgagtgataagttagccgagccgcccgttactctgaatgatatgttaagatctgtgtccacctcgaaaccaacagtcaatgatgaggatctgaccaaattgagaaagttcatggaggatttcgggcaagaaggataa

SEQ ID NO: 414 - DNA, 717 bp, Phyllotreta cruciferae; identical to SEQ ID NO: 413
  misc_feature: Vps4

SEQ ID NO: 415 - DNA, 717 bp, Phyllotreta cruciferae; identical to SEQ ID NO: 413
  misc_feature: Vps4

SEQ ID NO: 416 - DNA, 717 bp, Phyllotreta cruciferae; identical to SEQ ID NO: 413
  misc_feature: Vps4

SEQ ID NO: 417 - DNA, 717 bp, Phyllotreta cruciferae; identical to SEQ ID NO: 413
  misc_feature: Vps4

SEQ ID NO: 418 - DNA, 717 bp, Phyllotreta cruciferae; identical to SEQ ID NO: 413
  misc_feature: Vps4

SEQ ID NO: 419 - DNA, 717 bp, Phyllotreta cruciferae; identical to SEQ ID NO: 413
  misc_feature: Vps4

SEQ ID NO: 420 - DNA, 717 bp, Phyllotreta cruciferae; identical to SEQ ID NO: 413
  misc_feature: Vps4

SEQ ID NO: 421 - DNA, 717 bp, Phyllotreta cruciferae; identical to SEQ ID NO: 413
  misc_feature: Vps4

SEQ ID NO: 422 - DNA, 717 bp, Phyllotreta cruciferae; identical to SEQ ID NO: 413
  misc_feature: Vps4

SEQ ID NO: 423 - DNA, 717 bp, Phyllotreta cruciferae; identical to SEQ ID NO: 413
  misc_feature: Vps4

SEQ ID NO: 424 - DNA, 663 bp, Phyllotreta cruciferae
  misc_feature: snf7
acaatgagtttctttagtaaaatattcggaggaaaagaaaaggatgtgggccccacgccaggcgaagccatccaaaagctcagggaaaccgaggacatgttatataaaaaacaagagtttttagaaaagaaaatagaggaatatacactagtagccaaaaaaaatgcatcaaagaataagagagtcgcgctgcaggcgctcaaaaagaaaaaacgattggaaaaaactcaattacaaatcgatggcacactcactacaatcgaaatgcaaagggaggccctcgaaggagccagcaccaacacagccgtcttagattcaatgaagaatgcagctgaagctctccaaaaagcccacaaaaacttgaatgtcgatgatgtccacgacatcatggatgacatagctgaacagcatgacattgccaacgagattactactgctattagccagccggtaggcttcgctgatgatttggacgaggatgaattagaaagcgaactagaaaagctcgaacaagaaggattagaggaagatttgctgaaagttccaggcccaactgaactacctgctgtacctacaggagctattgccaagcccgttaaacctgctgctaaaaaagtggaggatgatgatgacatgaaagaattggaagcttgggcttcataa

SEQ ID NO: 425 - DNA, 663 bp, Phyllotreta cruciferae; identical to SEQ ID NO: 424
  misc_feature: snf7

SEQ ID NO: 426 - DNA, 663 bp, Phyllotreta cruciferae; identical to SEQ ID NO: 424
  misc_feature: snf7

SEQ ID NO: 427 - DNA, 663 bp, Phyllotreta cruciferae; identical to SEQ ID NO: 424
  misc_feature: snf7

SEQ ID NO: 428 - DNA, 663 bp, Phyllotreta cruciferae; identical to SEQ ID NO: 424
  misc_feature: snf7

SEQ ID NO: 429 - DNA, 663 bp, Phyllotreta cruciferae; identical to SEQ ID NO: 424
  misc_feature: snf7

SEQ ID NO: 430 - DNA, 663 bp, Phyllotreta cruciferae; identical to SEQ ID NO: 424
  misc_feature: snf7

SEQ ID NO: 431 - DNA, 663 bp, Phyllotreta cruciferae; identical to SEQ ID NO: 424
  misc_feature: snf7

SEQ ID NO: 432 - DNA, 663 bp, Phyllotreta cruciferae; identical to SEQ ID NO: 424
  misc_feature: snf7

SEQ ID NO: 433 - DNA, 663 bp, Phyllotreta cruciferae; identical to SEQ ID NO: 424
  misc_feature: snf7

SEQ ID NO: 434 - DNA, 663 bp, Phyllotreta cruciferae; identical to SEQ ID NO: 424
  misc_feature: snf7

SEQ ID NO: 435 - DNA, 1065 bp, Phyllotreta cruciferae
  misc_feature: Vatpase D
aagtttcgattttcgatcatgaaggggtgtctttttaacatcgacaacggttacttggaaggtctatgccgcggcttcaaatgcggcatattgaagcaagccgattacctcaatttagtgcaatgcgaaactctggaagatttgaagctgcatttacaaggcacagactacggcacgttcctggccaacgaaccctccccattgtcagtatccaccatcgacgacaaattgagggaaaaactcgtcatcgagttccagcatatgcgtaaccaagccgtagaacccctgtccacattcctggacttcatcacctacagttacatgatcgataacataattcttttaatcaccggaactttgcatcaaagacccattggtgagttgattccaaaatgccaccccctcggcagcttcgagcaaatggaagccatccacgtagcagccactccagcggaattgtacaacgcggtgttagtagacactccgctagctcctttcttcgtcgattgcatcagcgagcaagatttggacgagatgaacatcgaaatcatcaggaacactctgtacaaagcctacttggaggctttcttcaccttctgcaaggaaatcggaggcaccactgctgacagcatgtgcgaaatcctggctttcgaagccgatagacgtgctataatcatcactatcaactccttcggaacggaattgagcaaagatgaccgcgctaagttgtacccgcgttgcggaaaactccagcctgatggtttggccgctctagctagagctgaggattacgagcaggtcaaagctgtggccgagtattatgctgagtactccaaattgttcgagggggctggaaacaatccgggagataagacgttggaggacaaattcttcgagcatgaagtgcgcctgaacatcaacgcgttcatgcaacagttccacttcggtgtgttctattcctatttgaagctgaaggagcaggaatgcaggaacatcgtttggatcgcagagtgcgtggctcagaagcacagggccaagatcgataactacattccgatattctag

SEQ ID NO: 436 - DNA, 1065 bp, Phyllotreta cruciferae; identical to SEQ ID NO: 435
  misc_feature: Vatpase D

SEQ ID NO: 437 - DNA, 1065 bp, Phyllotreta cruciferae; identical to SEQ ID NO: 435
  misc_feature: Vatpase D

SEQ ID NO: 438 - DNA, 1065 bp, Phyllotreta cruciferae; identical to SEQ ID NO: 435
  misc_feature: Vatpase D

SEQ ID NO: 439 - DNA, 1065 bp, Phyllotreta cruciferae; identical to SEQ ID NO: 435
  misc_feature: Vatpase D

SEQ ID NO: 440 - DNA, 606 bp, Phyllotreta cruciferae
  misc_feature: RpL19
aaaatgagttcgttaaaactccagaagaggctcgcagcctctgttatgagatgcggcaaaaagaaggtatggttggatcctaacgaaatcaacgaaatcgccaatacaaattcaagacaaaacatccgcaagctgattaaagatggtttgatcatcaagaagcctgtagcagtgcactcacgtgcccgtgtccgcaagaacaccgaagcccgcaggaagggtaggcactgcggttttggtaaaaggaaaggtacagcgaacgctcgaacaccaagaaaagaattatggattcaacgtatgagagtccttcgtcgtttgttgaaaaagtaccgtgaggccaagaaaatcgacagacatctgtaccattcgctgtacatgaaggcaaagggtaacgtattcaagaacaagcgtgtcctgatggaatacatccacaagaagaaggctgagaaggctcgcgccaagatgttggccgaccaggcgaacgccaagagaatgaaggtcaaacgcgccagggaaagacgtgaagaacgtatcgctacgaagaagcaggaagttttgcagaattaccagagggaagacgaagctgccgctgctactaaaaaatag

SEQ ID NO: 441 - DNA, 606 bp, Phyllotreta cruciferae; identical to SEQ ID NO: 440
  misc_feature: RpL19

SEQ ID NO: 442 - DNA, 606 bp, Phyllotreta cruciferae; identical to SEQ ID NO: 440
  misc_feature: RpL19

SEQ ID NO: 443 - DNA, 606 bp, Phyllotreta cruciferae; identical to SEQ ID NO: 440
  misc_feature: RpL19

SEQ ID NO: 444 - DNA, 606 bp, Phyllotreta cruciferae; identical to SEQ ID NO: 440
  misc_feature: RpL19

SEQ ID NO: 445 - DNA, 1248 bp, Phyllotreta cruciferae
  misc_feature: RpL3
gtcaacatgtcgcacaggaagtttagtgcaccccgtcatggatccatgggattctaccccaagaaaagatcccaaaggcaccgtggaaaagtaaaggctttccccaaggatgatccctcgaaacccgttcatttaacagctttcattggctacaaagccggtatgacccacgtgctacgtgaggcagacaggcctggttcgaaaatcaacaagaaggaaatcgtagaggctgtaaccattttggaaactcctccgatgattgtagtaggtgttgtgggttacatcgaaactccgcatggtatgagagctttggccaccgtttgggctgaacatttgtccgaagattgccgtagacgtttctacaagaactggtacaagagcaagaagaaggctttcaccaaggcgtccaagaaatggaccgatgatttgggtaagaagtccattgagcgcgacttgaagaaaatcgtcaaatactgcaaggttgtcagagtcatcgctcacactcagatgaaattgttgaaacaacgtcaaaagaaagcccatattatggaaattcaactcaacggaggtaccattgccgacaaagtcgcatgggctaaggagcatttggagaagcccattcccgttggcaacgttttcgctcaagatgagatgatcgattgcatcggtgtaaccaaaggtcatggatacaaaggtgttacatctcgttggcatacgaagaaattgccccgcaagacgcacaagggtcttaggaaagtcgcctgtattggagcctggcatccttctcgagtgtcattcactgtcgctcgtgctggtcaaaagggttaccatcacaggacggagatgaacaagaaaatctacagaatcggtgctggaattcacactaaggacggaaaggtcatcaaaaacaatgctgctaccgattacgatcttagtgagaagaccattacaccaatgggtggtttccctcattatggtgaagttaacaatgacttcgtcatgattaagggttgttgtatgggacctaagaagcgtgtcattacactgagaaaatctctcttggttcacactaagcgtattgctttggagaagatcaatttgaaattcatcgatacgtcgtccaaattcggacacggtagattccaaaccgccgccgacaaggctgcgtttatgggacctcttaagaaagatagagttaaggaagaagacaagactgcggccccagctgcagctgctgcttcgagttaa

SEQ ID NO: 446 - DNA, 1248 bp, Phyllotreta cruciferae; identical to SEQ ID NO: 445
  misc_feature: RpL3

SEQ ID NO: 447 - DNA, 1248 bp, Phyllotreta cruciferae; identical to SEQ ID NO: 445
  misc_feature: RpL3

SEQ ID NO: 448 - DNA, 1248 bp, Phyllotreta cruciferae; identical to SEQ ID NO: 445
  misc_feature: RpL3

SEQ ID NO: 449 - DNA, 1248 bp, Phyllotreta cruciferae; identical to SEQ ID NO: 445
  misc_feature: RpL3

SEQ ID NO: 450 - DNA, 546 bp, Phyllotreta cruciferae
  misc_feature: Proteasome alpha 2
tcatttgtgaaaatgtcatctgaacgttatagtttttctttaacaactttcagcccttcaggtaaactagtccaaatcgaatatgctttagcggcagtggcggctggtgctccttcagtaggaataaaagcatcaaatggagtggtaatagccacagaaaacaagcacaaatccattctttacgacgaacacagcgtccataaagtagaaatgatcacgaagcacatcggaatggtctattccgggatgggacctgactaccgtttgttggtcaagcaagcacgtaaaatggcccaacagtattacctggtttacaaagaaccaattcctactgttcagctagttcaacgtgttgcaactgtaatgcaggaatacactcaatccgggggagttagacccttcggagtgtccctattgatctgcggatgggacaacaacaggccttacttattccagtgcgatccttctggggcgtatttcgcttggaaagccaccgcaatgggaaagaattatgtcaacgggaagacgttcctcgagaaaaggtaa

SEQ ID NO: 451 - DNA, 546 bp, Phyllotreta cruciferae; identical to SEQ ID NO: 450
  misc_feature: Proteasome alpha 2

SEQ ID NO: 452 - DNA, 546 bp, Phyllotreta cruciferae; identical to SEQ ID NO: 450
  misc_feature: Proteasome alpha 2

SEQ ID NO: 453 - DNA, 546 bp, Phyllotreta cruciferae; identical to SEQ ID NO: 450
  misc_feature: Proteasome alpha 2

SEQ ID NO: 454 - DNA, 840 bp, Phyllotreta cruciferae
  misc_feature: Proteasome beta 5
atcatgagtttagaagcgttatcgggcattacaagctacaattccgaggattacgagcgactcgcctacgacgagagtctgcagaagtattgcaccaatttcaatggcatgaacttggccgttccgccttttcctgatcccagcaataactttgcaagattcaccaaagatgataatggccgtgagatcaaaattaagttcgaccacggtaccaccacattgggattcatgtacaaggggggcgtagtactcgcagtggattcccgagccactggaggccaattcattggatcacaaactgtagaaaaaatcataaaaatcaacagttttttgctagctacaatggcaggaggcgcggctgattgtacgtactgggaccgagtattagctaaacaatgtaggctgtacgaactgagaaacagggaacgtatttcggtggctgcggcttccaagttaatggccaatatggtttataattacaaaggaatgggtttgtccatgggaatgatgttggctggatgggacaaaaggggtcctcaactctactacgtcgattcagaaggtctaaggacagccgggaaagtgttcagcgtaggttcaggttccatttacgctttcggggtgcttgattctggatacaaatgggacttatccgatgaggaagcttatgatttaggtcgtagatcgatttaccacgctactcatagagacgcctattcaggaggtattgttagagtgtaccacatgaaagagactggttgggtgcacatcgatgataatgattgcatggacttgcattacaagtttgtggaggaaaaggagaaaatgggtggcgcttga

SEQ ID NO: 455 - DNA, 840 bp, Phyllotreta cruciferae; identical to SEQ ID NO: 454
  misc_feature: Proteasome beta 5

SEQ ID NO: 456 - DNA, 840 bp, Phyllotreta cruciferae; identical to SEQ ID NO: 454
  misc_feature: Proteasome beta 5

SEQ ID NO: 457 - DNA, 840 bp, Phyllotreta cruciferae; identical to SEQ ID NO: 454
  misc_feature: Proteasome beta 5

SEQ ID NO: 458 - DNA, 840 bp, Phyllotreta cruciferae; identical to SEQ ID NO: 454
  misc_feature: Proteasome beta 5

SEQ ID NO: 459 - DNA, 840 bp, Phyllotreta cruciferae; identical to SEQ ID NO: 454
  misc_feature: Proteasome beta 5

SEQ ID NO: 460 - DNA, 840 bp, Phyllotreta cruciferae; identical to SEQ ID NO: 454
  misc_feature: Proteasome beta 5

SEQ ID NO: 461 - DNA, 347 bp, Phyllotreta cruciferae
  misc_feature: Vps16A
gggaaatcagtccacgagacctgcaggatcctgttggacatgaaggagaccaagttggccgagaagttcaagaacgacttcaaaattcccgataaaaggtattggtggttgaaaatcaacagcctggccgatcagaacgattggatcgagctggaaaagttttccaaagcgaagaagtcccctatcggatacgctcccttcgtggacgtttgcttgaggcaggacaaacggcaggaggccctcaaatatctgcccaaagtcggcgacgacatcaaagtcaaatactgcatcaaagccgggtgcttggaagaggccgccgacatagcttatcatcaaagggacgtgcg

SEQ ID NO: 462 - DNA, 705 bp, Phyllotreta cruciferae
  misc_feature: VATP-E/Vha26
caaatacccgaaatcgcatccacgatggctctgagcgacgcagatgtccagaaacagatcaagcacatgatggctttcatcgagcaagaggccaacgagaaggccgaagaaatcgatgccaaagccgaggaggagttcaacatagaaaagggccgtttggtccaacagcagcgcctcaagatcatggaatactacgagaagaaggagaaacaagtcgagctccagaagaaaatccaatcgtccaacatgctgaaccaggccagattgaaggtgttgaaagtgagagaagaccacgtgagggccgtgctagaagacgcccgcaagcgcctcggcgaagtcacccgagaccagggaaagtacggccacatcatcgaaagcctcatccttcaaggactctaccagctgttcgagaaagaagtaacggtcagggtgcgcccgcaggacagggagctggtcaagtcgattctgggcaacgtgcaaaccaagtacaaggacatcacgggcaaagaggtgcacttgaagatcgacgatgagtcgcacttgtcgcaggagaccaccggagggatcgatttgctggcgctgaagaataaagtgaagatcaacaacacgctcgaggcgcgattggatttgatttcgcagcaattggtgccccaaatacgtaacgctttgttcgggcgtaacgtgaacaggaagttcaccgattag

SEQ ID NO: 463 - DNA, 705 bp, Phyllotreta cruciferae; identical to SEQ ID NO: 462
  misc_feature: VATP-E/Vha26

SEQ ID NO: 464 - DNA, 705 bp, Phyllotreta cruciferae; identical to SEQ ID NO: 462
  misc_feature: VATP-E/Vha26

SEQ ID NO: 465 - DNA, 705 bp, Phyllotreta cruciferae; identical to SEQ ID NO: 462
  misc_feature: VATP-E/Vha26

SEQ ID NO: 466 - DNA, 705 bp, Phyllotreta cruciferae; identical to SEQ ID NO: 462
  misc_feature: VATP-E/Vha26

SEQ ID NO: 467 - DNA, 705 bp, Phyllotreta cruciferae; identical to SEQ ID NO: 462
  misc_feature: VATP-E/Vha26

SEQ ID NO: 468 - DNA, 705 bp, Phyllotreta cruciferae; identical to SEQ ID NO: 462
  misc_feature: VATP-E/Vha26

SEQ ID NO: 469 - DNA, 1281 bp, Phyllotreta cruciferae
  misc_feature: VATP-A/Vha68-2
cttgagacagaattcgatggtgaacgatccaaattcaccatgttacaagtatggccagtccgtcaagccagaccggtcagcgagaaattaccggccaatcaccctctgcttaccggtcaacgtgtattggattctcttttcccttgcgtacaaggcggtacgacagccattcccggcgccttcggttgcggcaaaaccgtcatctcccaatcgctgtccaaatactccaactccgacgtcatcatctacgtgggttgcggcgagagaggcaacgaaatgtccgaagtgttgcgggacttccccgagctgagcgtggaaatcgacggccacaccgaatccatcatgaagcgtaccgcactggtggccaacacctccaacatgcccgtggccgcccgtgaggcctccatctatacgggtatcacgctatccgagtacttcagagacatgggttaccacgtatcgatgatggccgattccacgtcccgttgggccgaggcgttgagagaaatttccggtcgtttggccgagatgcccgccgattccggttacccggcctacttgggggcccgattggcctctttctacgagcgcgccggtcgcgttaagtgcttgggtaaccccgatagggaagggtctgtttcgatcgtaggagccgtgtcgccgcctggtggtgatttctctgatcctgtcacttccgctactcttggtatcgttcaagtgttttggggattggacaagaagcttgcccaacgtaagcacttcccgtctgtcgactggctgagttcatactctaaatatttgagggctttggatgatttctatgacaaaaacttccctgaatttataccgctaagaaccaaagttaaagaaatccttcaagaagaagacgaccttacggaaatcgtgcagctggtaggaaaagcttcattagctgaagctgataagattacattggaaatcgccaagctgttgaaagaagatttcctgcaacagaactcgtactcatcgtacgatagattctgtcccttctacaaaaccgtgggtatgttgaagaacatgattgggatgtacgatatggcgagacacgccgtggagtcgactgctcaatctgagaacaagatcacgtggacggtgatcagggattcgatgagcaacattttgtaccaattgagcagtatgaagttcaaggatccggtgaaagatggcgaggcgaagatcaaggcggatttcgatcagttgtacgaggatatccagcaggcgttcagaaatctggaggattaa

SEQ ID NO: 470 - DNA, 1281 bp, Phyllotreta cruciferae; identical to SEQ ID NO: 469
  misc_feature: VATP-A/Vha68-2

SEQ ID NO: 471 - DNA, 1281 bp, Phyllotreta cruciferae; identical to SEQ ID NO: 469
  misc_feature: VATP-A/Vha68-2

SEQ ID NO: 472 - DNA, 1281 bp, Phyllotreta cruciferae; identical to SEQ ID NO: 469
  misc_feature: VATP-A/Vha68-2

SEQ ID NO: 473 - DNA, 1281 bp, Phyllotreta cruciferae; identical to SEQ ID NO: 469
  misc_feature: VATP-A/Vha68-2

SEQ ID NO: 474 - DNA, 1281 bp, Phyllotreta cruciferae; identical to SEQ ID NO: 469
  misc_feature: VATP-A/Vha68-2

SEQ ID NO: 475 - DNA, 1281 bp, Phyllotreta cruciferae; identical to SEQ ID NO: 469
  misc_feature: VATP-A/Vha68-2

SEQ ID NO: 476 - DNA, 1281 bp, Phyllotreta cruciferae; identical to SEQ ID NO: 469
  misc_feature: VATP-A/Vha68-2

SEQ ID NO: 477 - DNA, 1281 bp, Phyllotreta cruciferae; identical to SEQ ID NO: 469
  misc_feature: VATP-A/Vha68-2

SEQ ID NO: 478 - DNA, 1281 bp, Phyllotreta cruciferae; identical to SEQ ID NO: 469
  misc_feature: VATP-A/Vha68-2

SEQ ID NO: 479 - DNA, 1281 bp, Phyllotreta cruciferae; identical to SEQ ID NO: 469
  misc_feature: VATP-A/Vha68-2

SEQ ID NO: 480 - DNA, 738 bp, Phyllotreta cruciferae
  misc_feature: Beta COPI
gccctaatgggcggcaagacggggcaatcggactccaccatcggctcgagtaaattgaacaagatcgcccagttgacgggtttctcggatcctgtttactccgaagcgtatgtgcacgttaatcagtacgatatcgtgctggacgtgttggtggtgaaccaaacgagcgacacgctgcagaattgtactctggagttggcgactctgggcgatttgaagttggtggagaagcctcagccggtcgttctggcgccgaaggatttctgcaatatcaaggctaacgtgaaagtggcctcgaccgagaatggtatcatattcggtaacatcgtgtacgacgtgacaggcgccgcttcggacaggaatgtagtcgttttgaacgacatacacatcgatattatggattacattgttccggcatcgtgcaccgattcggagtttatgaggatgtgggctgaattcgaatgggagaataaggtgaccgtcaatacgccgctgacggatctcaacgagtacctggagcatctgctgaagagtactaacatgaagtgcctgacatcagagaaggcgctcggcgggcaatgcggcttcatggcggccaatatgtacgcgaaatcgatcttcggggaggacgccctggcgaatttgagcatcgagaagccgttcaacaagccggacgcgcccgtcgccggtcacattagaattcgggccaaaagtcagggtatggctttgagtttgggc

SEQ ID NO: 481 - DNA, 738 bp, Phyllotreta cruciferae; identical to SEQ ID NO: 311
  misc_feature: Beta COPI

SEQ ID NO: 482 - DNA, 738 bp, Phyllotreta cruciferae; identical to SEQ ID NO: 311
  misc_feature: Beta COPI

SEQ ID NO: 483 - DNA, 738 bp, Phyllotreta cruciferae; identical to SEQ ID NO: 311
  misc_feature: Beta COPI

SEQ ID NO: 484 - DNA, 738 bp, Phyllotreta cruciferae; identical to SEQ ID NO: 311
  misc_feature: Beta COPI

SEQ ID NO: 485 - DNA, 1248 bp, Phyllotreta cruciferae; identical to SEQ ID NO: 445
  misc_feature: RpL3

SEQ ID NO: 486 - DNA, 1248 bp, Phyllotreta cruciferae; identical to SEQ ID NO: 445
  misc_feature: RpL3

SEQ ID NO: 487 - DNA, 1248 bp, Phyllotreta cruciferae; identical to SEQ ID NO: 445
  misc_feature: RpL3

SEQ ID NO: 488 - DNA, 1248 bp, Phyllotreta cruciferae; identical to SEQ ID NO: 445
  misc_feature: RpL3

SEQ ID NO: 489 - DNA, 353 bp, Phyllotreta cruciferae; identical to SEQ ID NO: 301
  misc_feature: RpL40

SEQ ID NO: 490 - DNA, 255 bp, Phyllotreta cruciferae
  misc_feature: RpS21
aacatggaaaacgacgctggtgaaaccgtcgacttgtactgcccaagaaaatgctctgctagcaacagaattattcatgctaaggaccacgctagcattcaactcagcgtcgccgacgttgatcctttaaccggaagaatgaccgaaagttccaagagctacgctctctgcggagctatcaggcgtatgggagaatcggacgattgtattgtgaggttaacgaagaaagatggaatcctagccaaaaacttctaa

SEQ ID NO: 491 - DNA, 822 bp, Phyllotreta cruciferae
  misc_feature: RpS4
cacgcctgctctgtctttcatatttttaaagtcaagatggctcggggacctaaaaagcacttgaagcgtttaaatgcgccgaaagcatggatgttggacaaattgggaggtgtattcgcaccccgcccgtccaccggtcctcacaaactccgagaatcattacccttggtgattttcttaagaaacaggctgaagtatgctctcactaacagcgaggtaactaaaatagttatgcaaagattaatcaaagtcgatggaaaagtcaggaccgactccaactaccccgcaggttttatggatgttatcaccattgaaaaaactggtgaatttttccgtctcatctatgatgtgaaaggaagatttgctatccaccgtattactgctgaagaagctaaatacaagctttgcaaagttaagagggttcaaaccggtcccaaaggaattccgtttttggtgacccacgatggtcgtacaatccgttaccctgatcctgtcatcaaggtaaacgacacaattcaattggagatcgctacgtctaaaattctcgattacatcaagtttgaatccaacaacttgtgtatgatcaccggaggtagaaatttgggtcgtgtcggtacgatcatgaacagggaacgtcatcctggatccttcgatattgtacatattaaggatgctaacggtcatgcctttgctactaggttaaataatgtattcgtaattggtaaaggagctaaggcttttgtgtctcttccaagaggtaaaggtgtgaagctatccattgccgaagaaagggataaaaggctagctgcaaaaacacactaa

SEQ ID NO: 492 - DNA, 822 bp, Phyllotreta cruciferae; identical to SEQ ID NO: 491
  misc_feature: RpS4

SEQ ID NO: 493 - DNA, 822 bp, Phyllotreta cruciferae; identical to SEQ ID NO: 491
  misc_feature: RpS4

SEQ ID NO: 494 - DNA, 822 bp, Phyllotreta cruciferae; identical to SEQ ID NO: 491
  misc_feature: RpS4

SEQ ID NO: 495 - DNA, 822 bp, Phyllotreta cruciferae; identical to SEQ ID NO: 491
  misc_feature: RpS4

SEQ ID NO: 496 - DNA, 822 bp, Phyllotreta cruciferae; identical to SEQ ID NO: 491
  misc_feature: RpS4

SEQ ID NO: 497 - DNA, 822 bp, Phyllotreta cruciferae; identical to SEQ ID NO: 491
  misc_feature: RpS4

SEQ ID NO: 498 - DNA, 1166 bp, Phyllotreta cruciferae; identical to SEQ ID NO: 304
  misc_feature: Rpn2

SEQ ID NO: 499 - DNA, 1166 bp, Phyllotreta cruciferae; identical to SEQ ID NO: 304
  misc_feature: Rpn2

SEQ ID NO: 500 - DNA, 1166 bp, Phyllotreta cruciferae; identical to SEQ ID NO: 304
  misc_feature: Rpn2

SEQ ID NO: 501 - DNA, 1166 bp, Phyllotreta cruciferae; identical to SEQ ID NO: 304
  misc_feature: Rpn2

SEQ ID NO: 502 - DNA, 1166 bp, Phyllotreta cruciferae; identical to SEQ ID NO: 304
  misc_feature: Rpn2

SEQ ID NO: 503 - DNA, 1166 bp, Phyllotreta cruciferae; identical to SEQ ID NO: 304
  misc_feature: Rpn2

SEQ ID NO: 504 - DNA, 1166 bp, Phyllotreta cruciferae; identical to SEQ ID NO: 304
  misc_feature: Rpn2

SEQ ID NO: 505 - DNA, 1166 bp, Phyllotreta cruciferae; identical to SEQ ID NO: 304
  misc_feature: Rpn2

SEQ ID NO: 506 - DNA, 1166 bp, Phyllotreta cruciferae; identical to SEQ ID NO: 304
  misc_feature: Rpn2

SEQ ID NO: 507 - DNA, 1166 bp, Phyllotreta cruciferae; identical to SEQ ID NO: 304
  misc_feature: Rpn2

SEQ ID NO: 508 - DNA, 1166 bp, Phyllotreta cruciferae; identical to SEQ ID NO: 304
  misc_feature: Rpn2

SEQ ID NO: 509 - DNA, 624 bp, Phyllotreta cruciferae
  misc_feature: Rpt6
gctagagctgtagctcaccacacagaatgcacgtttattagagtatcaggatcggagttggtgcaaaaattcattggggaaggttctaggatggtaagggaactgttcgtaatggctagggagcatgccccttcgatcattttcatggatgaaatcgattctattggatcctctcgtatcgaatcaggttctggtggcgattccgaagttcaaagaactatgctggagttgctgaatcaactcgatggatttgaggctacgaagaacattaaagttataatggctacaaacagaatcgacattttggatcccgctttactcaggcccggcagaattgacaggaagatcgagttccctccaccgaacgaggaagcccgattggacatcttgaaaattcactcgagaaaaatgaatttgaccagagggatcaatttgaggaaaatcgccgaattgatgccaggtgccagcggtgccgaagtgaagggagtgtgtactgaggcaggcatgtacgccctaagggagagaagggtacacgtaacccaagaagatttcgaaatggctgtggccaaggtcatgcagaaggattcagagaagaatatgtcgattaaaaaattatggaaataa

SEQ ID NO: 510 - DNA, 624 bp, Phyllotreta cruciferae; identical to SEQ ID NO: 509
  misc_feature: Rpt6

SEQ ID NO: 511 - DNA, 624 bp, Phyllotreta cruciferae; identical to SEQ ID NO: 509
  misc_feature: Rpt6

SEQ ID NO: 512 - DNA, 465 bp, Phyllotreta cruciferae
  misc_feature: sec23
agaggttgcatacaattcattactcagtatcaacactcaagtggtcaaagaagaattagagtgacaacagtggctcgaaactgggctgatgccactactaatatccaccacatcagcgctggttttgatcaggaagcagcagctgtaattatggccagaatggctgtttatagagctgaatcagatgagagtcccgacgttctgagatgggtcgatagaatgctgattcgattgtgtcaaaaattcggagaatacaataaagacgatgctggttcattcagattaggccaaaactttagcctctatccgcaattcatgtaccatctaaggaggtctcagttcttgcaagttttcaataattctcctgatgaaacgtcgttctatagacatatgttgatgagagaagatcttactcaatcattgatcatgattcaaccaattttgtacagttacagtttcaacggc

SEQ ID NO: 513 - DNA, 465 bp, Phyllotreta cruciferae; identical to SEQ ID NO: 512
  misc_feature: sec23

SEQ ID NO: 514 - DNA, 465 bp, Phyllotreta cruciferae; identical to SEQ ID NO: 512
  misc_feature: sec23

SEQ ID NO: 515 - DNA, 465 bp, Phyllotreta cruciferae; identical to SEQ ID NO: 512
  misc_feature: sec23

SEQ ID NO: 516 - DNA, 465 bp, Phyllotreta cruciferae; identical to SEQ ID NO: 512
  misc_feature: sec23

SEQ ID NO: 517 - DNA, 465 bp, Phyllotreta cruciferae; identical to SEQ ID NO: 512
  misc_feature: sec23

SEQ ID NO: 518 - DNA, 663 bp, Phyllotreta cruciferae; identical to SEQ ID NO: 424
  misc_feature: snf7/shrb

SEQ ID NO: 519 - DNA, 738 bp, Phyllotreta cruciferae; identical to SEQ ID NO: 311
  misc_feature: Beta COPI

SEQ ID NO: 520 - DNA, 738 bp, Phyllotreta cruciferae; identical to SEQ ID NO: 311
  misc_feature: Beta COPI

SEQ ID NO: 521 - DNA, 738 bp, Phyllotreta cruciferae; identical to SEQ ID NO: 311
  misc_feature: Beta COPI

SEQ ID NO: 522 - DNA, 738 bp, Phyllotreta cruciferae; identical to SEQ ID NO: 311
  misc_feature: Beta COPI

SEQ ID NO: 523 - DNA, 738 bp, Phyllotreta cruciferae; identical to SEQ ID NO: 311
  misc_feature: Beta COPI

SEQ ID NO: 524 - DNA, 738 bp, Phyllotreta cruciferae; identical to SEQ ID NO: 311
  misc_feature: Beta COPI

SEQ ID NO: 525 - DNA, 1167 bp, Phyllotreta cruciferae
  misc_feature: Act5C
gtaagagtagtaaatagcttagaagcacttgcggtgaacgattccagggccggattcgtcgtattcctgtttggagatccacatctgttggaaagtggaaagagaagccaagatggatccaccgatccatacggagtatttcctttctgggggagcaatgatcttgatcttgattgtgctgggggcaagagcggtgatttccttttgcatacggtcagcaataccagggtacatggtggtaccaccggagagtacagtgttggcgtacaagtccttacggatgtcgacgtcgcacttcatgatggagttgtatacggtttcgtggataccgcaggattccatacccaagaaggaaggttggaagagagcctcagggcaacggaatctttcgttaccgatggtgatgacttgaccgtcgggaagttcgtagctcttttcgagggaggtggaggcggcggcggtggccatttcctgttcgaagtcgagggcgacatagcagagtttctccttgatgtcgcggacgatttccctttcagcggtggtggtgaacgagtaacccctttcggtgaggattttcatgaggtagtcggtcaaatcgcgaccggccaagtccaaacggaggatggcgtggggaagagcgtaaccttcgtagatcggtacggtgtgggttacaccgtcaccggagtccaatacaataccggtggtacgaccggaagcgtagagggagagtacggcttggatggcgacgtacatggccggtgtgttgaaggtttcaaacatgatttgggtcatcttttccctgttggctttagggttaagaggagcctcggtcaagaggacggggtgttcttccggagcgacacggagttcgttgtagaaggtgtggtgccagatcttttccatgtcatcccagttggtgatgataccgtgttcgatggggtatttcaaagtgaggatacctcttttgctttgggcctcgtctcctacgtaggagtccttttgtcccataccgaccatcacaccctgatgtcttgggcgaccgacgatcgaggggaagacggcgcgcggggcgtcgtctccggcgaaaccagccttgcacataccggatccattgtcaacgacaagagccgcaacatcgtcgtcacacatgttgtcttctgtggttga

SEQ ID NO: 526 - DNA, 1167 bp, Phyllotreta cruciferae; identical to SEQ ID NO: 525
  misc_feature: Act5C

SEQ ID NO: 527 - DNA, 1167 bp, Phyllotreta cruciferae; identical to SEQ ID NO: 525
  misc_feature: Act5C

SEQ ID NO: 528 - DNA, 1167 bp, Phyllotreta cruciferae; identical to SEQ ID NO: 525
  misc_feature: Act5C

SEQ ID NO: 529 - DNA, 1167 bp, Phyllotreta cruciferae; identical to SEQ ID NO: 525
  misc_feature: Act5C

SEQ ID NO: 530 - DNA, 1167 bp, Phyllotreta cruciferae; identical to SEQ ID NO: 525
  misc_feature: Act5C

SEQ ID NO: 531 - DNA, 1167 bp, Phyllotreta cruciferae; identical to SEQ ID NO: 525
  misc_feature: Act5C

SEQ ID NO: 532 - DNA, 1167 bp, Phyllotreta cruciferae; identical to SEQ ID NO: 525
  misc_feature: Act5C

SEQ ID NO: 533 - DNA, 1508 bp, Phyllotreta striolata
  misc_feature: Arg. Kinase
gatatcagttgaagatttcaacccgacaacactacaccaagaagagccaccatggtagacgccgccgttttggacaaacttgaatccggtttcaagaaaatcaaggactccgactccaaatcgctgctgaagaagcacctcacccaggagatcttcgacaacttgaagaccaagaagacccccactttcggctcgactcttcttgatgtcatccaatccggcttggagaaccacgactccggcgtaggaatctacgcccccgacgctgaatcgtacaccgtattcgcggacatcttcgatcccatcatcgaggactaccacggcggcttcaagaagaccgacaagcacccgcccaagaactggggcgacgtcagcgtcttcggcgatctcgaccccaccggcgaatacgtcgtctccacccgcgtcagatgcggccgctccctggagggataccccttcaacccctgcttgaccgaggaccagtacaaggagatggagcagaaggtgtccagcaccctctccgggctcgaaggtgaactcaaggggaccttctacccgttgaccggaatgagcaaggacgtgcagcagaagctcatcgacgatcacttcctgttcaaggagggcgatcgcttcctgcaggccgccaacgcttgccgcttctggcccaccggtcgcggtattttccacaacgacgccaagaccttcttggtgtggtgcaacgaggaggaccaccttcgcatcatctccatgcagatgggaggcgacctgggagccgtcttcagacgattggtaaccgccgtcaacgacatcgaaaagagacttccgttctcccacaacgacaggctcggtttcctgaccttctgcccgactaacttgggtaccactgtccgcgcttcggtccatatcaaggtgcccaagttggctgccaacaaggccaagctggaggaggtcgctgccaagtacaacttgcaggtgcgcggtactcgcggtgaacacaccgaggccgaaggcggtgtctacgacatctccaacaagagacgcatgggtctcacggagttcgatgccgttaaggagatgtacgatggcatccaagaaatcattaagattgaaaaagaattgtaaacgttacaaacccctatatattacattcgtcaccattcgtgattttaaaaatatatatgtaagcgatggtatataaatatatatgtacatgtatgtattttacattaagtatctcgtttgccaaaggtattatcgcagataattgctttcaaaaacgctctgtttgtaatttttaagttgttgagataatgtcaagtctgaaacccagcttcattctagtcgacattttgttttcaaatttgattttatttatacaaatgatgtcaaacattgaacaatgttactgtattatttataatttatttttattgtaattctgacaaataaaagtattgtttggaaaacaccaaaaaaacaaaaaaaaaaaaaaaaaaaaaaaaaaaaaa

SEQ ID NO: 534 - DNA, 1508 bp, Phyllotreta striolata; identical to SEQ ID NO: 533
  misc_feature: Arg. Kinase

SEQ ID NO: 535 - DNA, 138 bp, Phyllotreta striolata
  misc_feature: COPI alpha
ctattaaaggaaggaatggatgaaacgatgcccagttcactccgcgatcgtgtccttccaaaacgtgcttcaccacagcatcggcttggccaaatagctcggtggctcccggatttttgaggtggtcttcgaggcccg

SEQ ID NO: 536 - DNA, 138 bp, Phyllotreta striolata; identical to SEQ ID NO: 535
  misc_feature: COPI alpha

SEQ ID NO: 537 - DNA, 231 bp, Phyllotreta striolata
  misc_feature: Rpn6-PB-like protein
gctctcagcaatttacccaaagctcgagccgctctaacttccgctagaacgaccgctaacgctatttattgccctccaaagatgcaggccgccctcgatctgcaatcgggcgtgctgcacgcagccgatgaaaaggatttcaagacagcttactcctatttttacgaagccttcgaagggttcgatagcgtcgaatctcccaaagctctgactgctcttaagtacatgctt

SEQ ID NO: 538 - DNA, 231 bp, Phyllotreta striolata; identical to SEQ ID NO: 537
  misc_feature: Rpn6-PB-like protein

SEQ ID NO: 539 - DNA, 231 bp, Phyllotreta striolata; identical to SEQ ID NO: 537
  misc_feature: Rpn6-PB-like protein

SEQ ID NO: 540 - DNA, 219 bp, Phyllotreta striolata
  misc_feature: 40S ribosomal protein S14
cttacacttggcagcaacttgttgggcagccaacatagcagcataaggagaagactcatcacgatcagccttaacttgcataccaccagtaacacgagagatggtttcacgaccagagagatcggtaacgtgaacgaaagtatcgttgaaagaagcaaagatgtgggcaacaccgaaaacgagttcaccttcacgaacttgaggaccgagagtgacctt

SEQ ID NO: 541 - DNA, 219 bp, Phyllotreta striolata; identical to SEQ ID NO: 540
  misc_feature: 40S ribosomal protein S14

SEQ ID NO: 542 - DNA, 219 bp, Phyllotreta striolata; identical to SEQ ID NO: 540
  misc_feature: 40S ribosomal protein S14

SEQ ID NO: 543 - DNA, 219 bp, Phyllotreta striolata; identical to SEQ ID NO: 540
  misc_feature: 40S ribosomal protein S14

SEQ ID NO: 544 - DNA, 177 bp, Phyllotreta striolata
  misc_feature: Coatomer alpha subunit, putative
tattaaaggaaggaatggatgaaacgatgcccagttcactccgcgatcgtgtccttccaaaacgtgcttcaccacagcatcggcttggccaaatagctcggtggctcccggatttttgaggtggtcttcgaggcccgtggggtgtggtgccacgttcttcttacgcaggcctgttaa

SEQ ID NO: 545 - DNA, 249 bp, Phyllotreta striolata
  misc_feature: 60S ribosomal protein L13
cccagaccagctgccggccctctgcgacccgtcgtgcgctgtcccacagtcaggtaccacaccaaaatacgcgccggacgcggattcaccctgcaagaattaaaagccgcgggacttaacccgagattcgccaggaccgtcggcgtcgccgtcgaccacaggaggaggaacaagtccgtagaatccattcaactaaacgctcaacgtttgaaagaatacaaatccaagttgatcctgttccccatccac

SEQ ID NO: 546 - DNA, 249 bp, Phyllotreta striolata; identical to SEQ ID NO: 545
  misc_feature: 60S ribosomal protein L13

SEQ ID NO: 547 - DNA, 249 bp, Phyllotreta striolata; identical to SEQ ID NO: 545
  misc_feature: 60S ribosomal protein L13

SEQ ID NO: 548 - DNA, 195 bp, Phyllotreta striolata
  misc_feature: Tubulin gamma chain
tatattagtatgattagccaacataagacctgagactcggtgagcggactgaatgtaaggagacttcctcgatagagccacctgtatactagccgggccccaagggatgaactgggcgagtttgcgttcgcgtatcctttgcaacgatttatgcacttgagtagcatccacctctccctgaaataccacaattat

SEQ ID NO: 549 - DNA, 195 bp, Phyllotreta striolata; identical to SEQ ID NO: 548
  misc_feature: Tubulin gamma chain

SEQ ID NO: 550 - DNA, 195 bp, Phyllotreta striolata; identical to SEQ ID NO: 548
  misc_feature: Tubulin gamma chain

SEQ ID NO: 551 - DNA, 195 bp, Phyllotreta striolata; identical to SEQ ID NO: 548
  misc_feature: Tubulin gamma chain

SEQ ID NO: 552 - DNA, 255 bp, Psylliodes chrysocephala
  misc_feature: RpS21
ataatggaaaacgacgcaggagaaaccgttgatttgtactgcccaagaaaatgttctgccagtaacagaattatccatgctaaggaccatgctagcatccaacttagcatagctgatgttgacccagcaactggtagaatgaccgagaactcgaaaagctatgctctttgtggagctattaggagaatgggtgaatcagatgattgcattgtgaggctaacgaagaaagatggaatcttagctaaaaacttttaa

SEQ ID NO: 553 - DNA, 255 bp, Psylliodes chrysocephala; identical to SEQ ID NO: 552
  misc_feature: Sar1

SEQ ID NO: 554 - DNA, 255 bp, Psylliodes chrysocephala; identical to SEQ ID NO: 552
  misc_feature: Sar1

SEQ ID NO: 555 - DNA, 255 bp, Psylliodes chrysocephala; identical to SEQ ID NO: 552
  misc_feature: Sar1

SEQ ID NO: 556 - DNA, 255 bp, Psylliodes chrysocephala; identical to SEQ ID NO: 552
  misc_feature: Sar1

SEQ ID NO: 557 - DNA, 255 bp, Psylliodes chrysocephala; identical to SEQ ID NO: 552
  misc_feature: Sar1

SEQ ID NO: 558 - DNA, 255 bp, Psylliodes chrysocephala; identical to SEQ ID NO: 552
  misc_feature: Sar1

SEQ ID NO: 559 - DNA, 2931 bp, Psylliodes chrysocephala
  misc_feature: COPI Beta
tttaaatactaccgaaaaataaatctacaattcttatttcaccagaatcgcgttctaattaaaatgactgccgttgaacagtcttgttatactttaattaatctaccaactgattcggagccctacaatgaaatgcagctcaaaatggacctcgaaaagggcgaggttaaggtaaaaataagagcacttgaaaggattatacacatgatattagctggagaaagattaccaaacggattcttaatgactattataaggaatgtccttccccttcaggatcatttagctaagaaattacttctaattttttgggaaattgtaccaaaaacttcacctgatggcaaattattacaagaaatgattttagtgtgtgatgcctacagaaaagatctgcaacacccaaacgaatttcttcgaggttctactttaagattcttatgtaaattaaaagaaccagaactgctagaacctctaatggctagtatcagagcctgtttggatcacaggcacagttatgtgcgaagaaatgcagttttggctatttttacaatttatagaaattttgagttcttaattcctgatgcacccgaacttatttctacttatttagatggtgagcaggatatgtcttgcaagagaaatgcttttctgatgcttttacatgctgatcaagatagagcactgtcttatttggcaaattgtctagatcaagttacatcatttggagacattctgcaattggtcattgttgaattaatctataaagtttgccattcaaatcccacagagaggtcaagatttatccgctgcatttacaatctattaaattcaagcagtcctgctgtcagatatgaagctgctggtacacttgtaacactttcaagtgctcccacagcagtaaaagcagctgctagttgttatattgaactaattatcaaggaaagtgataataatgtaaagttgattgtcttggacagattgattgcccttaaggaacatcccagccatgaaagggttttgcaagatttggttatggatatattaagagtgttgcaagctcctgacttggaagttcgcaaaaagactttaaacctagcacttgaactggtatcatctcgtaatatagaagaaatggttttggttcttaaaaaggaggtatcaaaaaccgtagatagcgagcacgaagatacaggaaaatacaggcagttacttgttagaacacttcattcttgttgtataaaattcccagatgtagctgtaactgtcattcctgttttaatggaatttttgtctgatagtaacgagttagctgctactgacgtgttactatttttgagagaggccatacagaagtttgataatctgcaaccacttattattgagaaacttctagaaacattcaaagatataaaatctgttaaagtgcatagagcagctctttggatattgggagaatatgccacttctgtctcagacattgaagctgttattaaagaaattaatcaaaccttaggagaagctcctctgttggaaactgaacaaaaactaatttctggagagacagacgacacaactacagttccaacaggtggagctacaactttggttacttcagatggtacttacgccactcagtctgcctttaattcagtcagtaaatcttcaaaagaaaaacgacctcctctgaggcaatatcttatggatggtgatttttttataggagcgtccttggcttctactctaaccaaattagctttaagatatggtcaaattgcctcagctgctgatagaaataggtttgatgctgaagtcatgcttattatggcaggtatcatacatttaggcaaatcaggtttaccgacaaaaccaataaccaacgatgacaaagaccacatacttttttgcttgcgtgtcatctcagaccgcaccgacccaataatacaaattttctctactctgtgtcgatctgctctcaatgacatgttgatagcgaaggaaacggaagaagccacgactcaaaaatcgaaagaacaatccagacacactatccaaacagatgacgctatcagtttccttcaattagaagcggacaagagcggcgaacttggggaaaatgtattcgaaatgtctttatcacaagccttggtcggaggtagaggtggccaaacagactccctaatcagttccaataaattgaacaagataacacagttgactggattttcggatcccgtatattcagaagcttacgtccacgttaatcaatacgatatagttcttgatgttttaatagtgaatcaaacgaacgacactcttcaaaattgcacgctggaactggcgacgctgggcgatttgaaactcgtagaaaaacctcaacctgtcgtactcgcgcctaaagatttttgtaatattaaggcgaacgttaaggtagcttccacagaaaacggcattatatttggtaatattgtttacgacgtcaccggtgccgcttcagatagaaatgtagtggttttaaacgacattcatatcgatattatggattatattgttcccgcgagctgtacagataccgagtttatgaggatgtgggcagaatttgaatgggaaaataaggtcactgtaaatacacctctcacagacctcgccgattaccttgaccatctcttgaaaagtacaaacatgaaatgtctgacttccgaaaaagcccttagcggtcaatgcggatttatggccgccaatatgtatgccaaatctattttcggagaagacgcgcttgcaaatttgagcatagaaaagcctttcaacaaaccagatgcaccagtcgcagggcacatcaggattagagctaaaagtcaaggaatggctttgagtttaggtgataaaataaatatgacacaaaaaggaactcagagtaaagtagctgctgcatga

SEQ ID NO: 560 - DNA, 2931 bp, Psylliodes chrysocephala; identical to SEQ ID NO: 559
  misc_feature: COPI Beta

SEQ ID NO: 561 - DNA, 2931 bp, Psylliodes chrysocephala; identical to SEQ ID NO: 559
  misc_feature: COPI Beta

SEQ ID NO: 562 - DNA, 2931 bp, Psylliodes chrysocephala; identical to SEQ ID NO: 559
  misc_feature: COPI Beta

SEQ ID NO: 563 - DNA, 2931 bp, Psylliodes chrysocephala; identical to SEQ ID NO: 559
  misc_feature: COPI Beta

SEQ ID NO: 564 - DNA, 2931 bp, Psylliodes chrysocephala; identical to SEQ ID NO: 559
  misc_feature: COPI Beta

SEQ ID NO: 565 - DNA, 2931 bp, Psylliodes chrysocephala; identical to SEQ ID NO: 559
  misc_feature: COPI Beta

SEQ ID NO: 566 - DNA, 2931 bp, Psylliodes chrysocephala; identical to SEQ ID NO: 559
  misc_feature: COPI Beta

SEQ ID NO: 567 - DNA, 2931 bp, Psylliodes chrysocephala; identical to SEQ ID NO: 559
  misc_feature: COPI Beta

SEQ ID NO: 568 - DNA, 2931 bp, Psylliodes chrysocephala; identical to SEQ ID NO: 559
  misc_feature: COPI Beta

SEQ ID NO: 569 - DNA, 2931 bp, Psylliodes chrysocephala; identical to SEQ ID NO: 559
  misc_feature: COPI Beta

SEQ ID NO: 570 - DNA, 825 bp, Psylliodes chrysocephala
  misc_feature: RpL7
agttttgacaaacgacaaccgaaatctttcttttctgtcgtttcgttaaaaatggcaccgacagcggataaggctaaaactgacaaaaaaactaagaccgtaaagggactgcctgcagttcctgaatcggtcttaaaacaccgcaaaagacgtgaagcctctagggctaaaaggcttcaatccattgtaaagaagaagtctgaacaaatcaaaaagagaaaagatattttcaaaagagcagaacagtatgttaaggaatacagattaaaagaacgagatgaaataaggttaattcgtcaagctaaaaataagggtaatttctatgtacctggagaggctaaattggctttcgttatccgtattaagggtatcaataaagtagcaccaaaagtacgtaaagttcttcaacttttccgtctacttcagatcaacaatggagtttttgtaaaactcaacaaagctaccattaacatgcttagaatatgtgaaccttacattacatggggttaccccaatttgaaatctgttagggaattaatttacaagagaggttttgctaaagtgaatggacaaagagtatcaatcactagcaatcagatcattgaagacagattaggaaaatctggcattatctgtattgaagatttgattcatgaactgttcactgttggatccaggttcaaatatgcctccaacttcttatggcccttcaagctaaacacaccaactggtggctggcgtaagaagaccaatcactatgtagaaggtggtgactttggtaatagagaagataaaataaatgaacttctcagaagaatggtttaa

SEQ ID NO: 571 - DNA, 825 bp, Psylliodes chrysocephala; identical to SEQ ID NO: 570
  misc_feature: RpL7

SEQ ID NO: 572 - DNA, 825 bp, Psylliodes chrysocephala; identical to SEQ ID NO: 570
  misc_feature: RpL7

SEQ ID NO: 573 - DNA, 825 bp, Psylliodes chrysocephala; identical to SEQ ID NO: 570
  misc_feature: RpL7

SEQ ID NO: 574 - DNA, 825 bp, Psylliodes chrysocephala; identical to SEQ ID NO: 570
  misc_feature: RpL7

SEQ ID NO: 575 - DNA, 825 bp, Psylliodes chrysocephala; identical to SEQ ID NO: 570
  misc_feature: RpL7

SEQ ID NO: 576 - DNA, 825 bp, Psylliodes chrysocephala; identical to SEQ ID NO: 570
  misc_feature: RpL7

SEQ ID NO: 577 - DNA, 825 bp, Psylliodes chrysocephala; identical to SEQ ID NO: 570
  misc_feature: RpL7

SEQ ID NO: 578 - DNA, 825 bp, Psylliodes chrysocephala; identical to SEQ ID NO: 570
  misc_feature: RpL7

SEQ ID NO: 579 - DNA, 825 bp, Psylliodes chrysocephala; identical to SEQ ID NO: 570
  misc_feature: RpL7

SEQ ID NO: 580 - DNA, 825 bp, Psylliodes chrysocephala; identical to SEQ ID NO: 570
  misc_feature: RpL7

SEQ ID NO: 581 - DNA, 1149 bp, Psylliodes chrysocephala
  misc_feature: COPI Zeta
aagatggtatgtggtaaagatggtaaagaagacaaagaccatcttctctatacgaaaaagtttttagaagtgaaaaaacttttacttttgggaactggcgagtctggaaaaactacgatcatcaaacagatgaaaattttacatattaatggttactcagataatgaaagaaaagaaaaaatcccatacatcaaacaaaatattcatgaatctatctatgacatcatcactaatatgaataaaattaatcctcctgtcaaagtcaaaaacgaggaaactataaattcgatcgatttcatcgtgaaaataggccaagaaggaccaaatgaatttactccggaatactttaatcacgtaaaaaaagcttgggcagatgaaggtgtcaaagaaacgtttaatagatccaatgagtatcaacttattgatagtgcagaacatttcttaaaccaaatcgatgtcatccaaacatcgggtttcattccaacgaatcaagacattctattctgtcgaatcaaaacaatctcgattagcaaaatagacttcgaaataccgattccgaaaaaatacggaggcggcatggctgaattctggatgttcgatgtaggcgggcaacgtggcgaaagaaaaaaatggataaaagtgttcgccggcattcaggctattctatttttaatagcgtccagcgattttgatttgaaattaagagaagacgaaagcgttaatagacttcaggagtcttttaatctgtttcaagatatctattcaaatgtgtatgttaaagatgccgcaatgattgtttttctgaataagcaagacatacttcaaaggaagatcgaacaaggaagaaaaatagagaaatactttccggaatattcgaattttacaccttcgggaagagaagaatgcaatacagagtatgaaaaagttagattgtttatgaaaaacaagattttaggaattgcaagaatgcctgtattcgtagaaaatatgggaatgagaccaggtaaaaatatcaccgaacagctaaaaccgagggatgtatatatccacaataccatagcaacagatacgaaaaatatcagaaaagttttcgattctgttcacgagagcatccttcaaaaaatcgtcaaagacactggtattttgtaa

SEQ ID NO: 582 - DNA, 1149 bp, Psylliodes chrysocephala; identical to SEQ ID NO: 581
  misc_feature: COPI Zeta

SEQ ID NO: 583 - DNA, 1149 bp, Psylliodes chrysocephala; identical to SEQ ID NO: 581
  misc_feature: COPI Zeta

SEQ ID NO: 584 - DNA, 1149 bp, Psylliodes chrysocephala; identical to SEQ ID NO: 581
  misc_feature: COPI Zeta

SEQ ID NO: 585 - DNA, 1149 bp, Psylliodes chrysocephala; identical to SEQ ID NO: 581
  misc_feature: COPI Zeta

SEQ ID NO: 586 - DNA, 1149 bp, Psylliodes chrysocephala; identical to SEQ ID NO: 581
  misc_feature: COPI Zeta

SEQ ID NO: 587 - DNA, 1149 bp, Psylliodes chrysocephala; identical to SEQ ID NO: 581
  misc_feature: COPI Zeta

SEQ ID NO: 588 - DNA, 1149 bp, Psylliodes chrysocephala; identical to SEQ ID NO: 581
  misc_feature: COPI Zeta

SEQ ID NO: 589 - DNA, 1149 bp, Psylliodes chrysocephala; identical to SEQ ID NO: 581
  misc_feature: COPI Zeta

SEQ ID NO: 590 - DNA, 1149 bp, Psylliodes chrysocephala; identical to SEQ ID NO: 581
  misc_feature: COPI Zeta

SEQ ID NO: 591 - DNA, 3084 bp, Psylliodes chrysocephala
  misc_feature: Rpn2
atttccgaaaattttaattgtgcttgcaacgaaaacttattaagattttcaagtgcttttaaaatgaatattacttcagctgcggggataatatccctactagaagaaccaagaccagaattgaaagtatttgctctaaaaaaattagattccattgttgatgaattttggccagagatttcagaagctatcgagaaaattgaaattcttcatgaagacaaagtatttcaacagcaccaactggctgcattggtagcaagtaaagtttactaccatttgggagcatttgaagattccttaacatacgctttgggtgctggcgatctttttgatgtaaacgcccgaacagagtatgtggaaacgacacttgccaaatgtattgattattacacacaacatcgcattgctttggctgaaggcgtacgagatgcaaagcccattgatgccagacttgaggccattgtgaatcgtatgtttcaacgttgtttagatgacggacaaaaccgacaggccatgggactcgctttggaaactagaagaatggacatttttgaattgtccattacacaagctgatgacattattggtatgctgacctatgcttttcaggtcgctatgagtttgatccaaaaccgcgcattccgaaacaccgtcctgaggtctctagttggtctgtatcggggtctaactactcccgattacgtcaatatgtgccagtgtctaattttcttagacgaccctctcccagtggctgaaatcttagataaactcgtgtctggtaaagaagatactgaactgatggcctaccaaatagcattcgacctatacgagtcagcaactcagcagtttttggagagggtattggtagctcttagagctactgctccgattccgtcgctgctggaagagaaggctaaacccaagattggcgatcaagccagtagcacttcagctgaggcttcgactggcgatgccactgttagtgaatcaaagactgaagttgttaaggaagagaaatctattgatagtttgtctgatcatgaaaaagaacaccagaaacgtatcgaaaagttacacaccattctttcaggcgaagtgtccatcgaacttcatcttcaatttcttatcagatctaatcatgctgatctccttattttgaaacaaacaaaagaaaccgtccgcgttagtatttgtcatactgctaccgttatagctaatgctttcatgcacagcggtaccaccagtgatcaatttttaagagataacttagaatggttagcaagggctacaaattgggccaaactcacggctacggcttctcttggcgtaattcacaggggacacgagcaagaagctttgaccttaatgcagagctacttgcctaaagaagtggggcccagttccggatattcggaaggcggcgggctgtacgctctcggtctcatacacgccaaccacggcgctaatatcatcgattacctactcggtcagctgaaagatgctcagaacgaaatggtcagacacggtggttgtctgggtctcggtttggccgccatgggtacccacaggcacgacgtttatgaacaactcaaattcaatctctatcaagacgacgcgaataccggagaagccgctggtatagccatgggtatggtcatgttgggctccaataattcggcaactataatggatatggtggcgtacgcacaagaaagtcaacatgaaaaaatcctgcgtggattagcagtgggtataagtttcacgatgtacggtcgtctagaagaggccgattcactaatccatcagctgacttcagataaggatccaattttaagacggtccggaatgtataccttagccatggcttactgcggtactggacacaatcaagccatcaggaaattactacacgtagcggtgtcagatgtcaacgatgatgtccgaagagctgcagttacagctcttggtttcttgttattcagaacacccgaacaatgtccaagcgtagtttccctcttagccgaaagttacaatccacacgtgcgctacggagccgccatggctctaggtatcgcatgcgcgggaaccggtctgcgcgaagccatagccttactcgaaccgatggtcatgttcgatcccgttaactttgtgcgacagggcgctctcatcgcttccgccatgatcctcattcaacaaacggaacagacttgtccgaaggtcagttttttcaggcagacgtacgcttcagtcatttccaataagcacgaagacgttatggctaaatttggcgctattttagctcaaggaataatcgatgctggtggcaggaacgtcactttatcattacaatctagaactggtcacactaatatgttggctgtggtgggaacactggtgttcacacaatattggtactggttcccattgtctcattgcttggccttggcctttactcctacgtgtgttattgcgttaaatacacaactaaagatgcctaaattggaattcaagtcgaacgccaagcccagcctttatgcctatccggcgcccatggaggaaaagaaacgcgaagaacgggaaaaagtgacgacagcggtgctgagtatagccgctaggcagcgcaggagagaccacgaaagaaagcatcgcgacgaaaaaatggacgtggacgaagaaaaggacgacaaaaaaaccgaaaaggaagaaaagaaaccggaagaaaaaaaggaagacaagaagcccgaagagaagaaagcggacgacaagaaaccttcaacttcgacggccgatgataaaaaggaaaagaaagacgaaaaggaggagaagaagaaggaacccgaaccgaatttcgaaatcttgcaaaatcctgccaggaccatgaggcagcaattgaaggtgatcacaatcaacgatagcacgcagtacacggcgatgaaagatgtttcgataggcggcatcatcatggtgcgaaatttgaagcctggcgaagaagaattggtagaacctgtagcagcttttggtccaaagggcgaggatgaaaaagagccagaaccaccagaaccttttgaatggactgaggattag

SEQ ID NO: 592 - DNA, 3084 bp, Psylliodes chrysocephala; identical to SEQ ID NO: 591
  misc_feature: Rpn2

SEQ ID NO: 593 - DNA, 3084 bp, Psylliodes chrysocephala; identical to SEQ ID NO: 591
  misc_feature: Rpn2

SEQ ID NO: 594 - DNA, 3084 bp, Psylliodes chrysocephala; identical to SEQ ID NO: 591
  misc_feature: Rpn2

SEQ ID NO: 595 - DNA, 3084 bp, Psylliodes chrysocephala; identical to SEQ ID NO: 591
  misc_feature: Rpn2

SEQ ID NO: 596 - DNA, 3084 bp, Psylliodes chrysocephala; identical to SEQ ID NO: 591
  misc_feature: Rpn2

SEQ ID NO: 597 - DNA, 3084 bp, Psylliodes chrysocephala; identical to SEQ ID NO: 591
  misc_feature: Rpn2

SEQ ID NO: 598 - DNA, 3084 bp, Psylliodes chrysocephala; identical to SEQ ID NO: 591
  misc_feature: Rpn2

SEQ ID NO: 599 - DNA, 3084 bp, Psylliodes chrysocephala; identical to SEQ ID NO: 591
  misc_feature: Rpn2

SEQ ID NO: 600 - DNA, 672 bp, Psylliodes chrysocephala
  misc_feature: snf7/shrb
tttaaaatgagctttttcaataaaatattcggagggaaagaaaaagatgaaggtcctaccccaggcgaagctatccagaagcttagagaaactgaagaaatgttatacaaaaaacaggaatttttagaaaagaaaatagaagaatacacattattagctaagaaaaatgcctctaagaataaacgagtggcccttcaagctcttaagaagaagaaaagattggaaaagactcaactgcaaatcgatggaacacttacaactattgaaatgcaaagggaagccctcgaaggagctagtactaacacagcggttttagattctatgaaaaatgctgctgatgcccttaaaaaagcacacaagaacctggatgttgataatgttcatgatataatggatgatatagcggaacaacacgacattgccaatgagatcacaaacgctattagtaatccagttggtttctcagatgatatggatgaagatgaattagaaaaggaactggaggagctcgaacaagaaggtttagaagaagatttactcaaggttcccggacctacagaacttccagccgtgcccgctggagctattgctaagccggcagttgttaaacctgcagctagaaaagtcgaggatgacgatgatatgaaggaattagaagcatgggcatcataa

SEQ ID NO: 601 - DNA, 672 bp, Psylliodes chrysocephala; identical to SEQ ID NO: 600
  misc_feature: snf7/shrb

SEQ ID NO: 602 - DNA, 672 bp, Psylliodes chrysocephala; identical to SEQ ID NO: 600
  misc_feature: snf7/shrb

SEQ ID NO: 603 - DNA, 672 bp, Psylliodes chrysocephala; identical to SEQ ID NO: 600
  misc_feature: snf7/shrb

SEQ ID NO: 604 - DNA, 672 bp, Psylliodes chrysocephala; identical to SEQ ID NO: 600
  misc_feature: snf7/shrb

SEQ ID NO: 605 - DNA, 672 bp, Psylliodes chrysocephala; identical to SEQ ID NO: 600
  misc_feature: snf7/shrb

SEQ ID NO: 606 - DNA, 672 bp, Psylliodes chrysocephala; identical to SEQ ID NO: 600
  misc_feature: snf7/shrb

SEQ ID NO: 607 - DNA, 672 bp, Psylliodes chrysocephala; identical to SEQ ID NO: 600
  misc_feature: snf7/shrb

SEQ ID NO: 608 - DNA, 672 bp, Psylliodes chrysocephala; identical to SEQ ID NO: 600
  misc_feature: snf7/shrb

SEQ ID NO: 609 - DNA, 672 bp, Psylliodes chrysocephala; identical to SEQ ID NO: 600
  misc_feature: snf7/shrb

SEQ ID NO: 610 - DNA, 672 bp, Psylliodes chrysocephala; identical to SEQ ID NO: 600
  misc_feature: snf7/shrb

SEQ ID NO: 611 - DNA, 2160 bp, Psylliodes chrysocephala
  misc_feature: Vps27
atcagctattcttacaacaaaatgtttcgcaatagaaattttgatgcattgcttgaaaaagcaaccagccatttattaatggagctagatttagcatctacgctgcagatgtgcgatttgattagacagaatgatgtacaaccaagatatgccttaactgcattaagaaagaaactatactcacaaaatcctcattctgcattgtatgctttgttagttttggaaagtatggtaaaaaattgtggcataatagttcatgaagaattaaccactaaatcattctgtgatttccttcatgaattatcaaaaaccacacctcatgaaaatgttcgaagtaaactgttagaacttattcaaacctggaattttgtctttaggaagaatcctaaacatggagcgcttaaggaccttgtgaatacaatgaaaatggaaggtcacaaatttccaacacccagagaatcagatgcaatgttttcatctgacacagccccagaatgggctgatggagatgtgtgtcatagatgtcgtgtacaattcagtgtactccaaagaaagcatcattgcagagcctgtggtcaagtgttttgtggccagtgcacttcaaagacttctactttgcccaaatatggaattgaaaaggaggtgagagtatgtgatgcttgttatgatgaagttactaaaccagccactgcatcaaaatcttctatttcttccagtgaaacagatttgcctgaggaatatttaaaaagttcattggcacaacagaaacaggatcctcctaagaaaagtgaagatgaattgagagaagaggaggaactgcaattagctttagctttgagtcaatcagaagctgaagccaaagaaaaagaaaaaataagggcaacaagtgctttgtataatgtgaaagaaccaacaccagtcgaaagaccacaaactcctcctcagcctcaagaagatccagaattggctagatatttgaatcgttcctattgggaatcgcttaaaaccaacgatccaaacgatcgtcccacgagtccgtcggctccagctaccgctccatctcaaaacatcgaacccaaatttaagaccaaggaaaacggtttggcggaaaacgatcttgaagagtttatgagaacccttaaaggtcacgtcgaaattttcattaacaggatgaaaagtaactccagtagaggaagatcgatcgctaacgacacgagcgtgcaaactttgtttatgaacataacggcgatgcattcgcgacttctgcattacatccaagaacacgacgacagtcgcatccactacgaatgcctgcaagacaaaatgactcaagtaaaagacgcgagggctgctttggacgctctgcgcgaagaacacaatgaaaagatgagaagagaggctgaggagcaagaaagaatgcgtcaaatgcaaatggcgcataaattggaagtcatgaggaagaaaaaacaggaatatcttcagtaccagagacaattggcgctacaaaggatccaagaacaagagagagaaatgcaaatgagacaggaacagcaaaaacagcaatatatgttacctcaatatggatatatgaattctccacatcatggacaacagtttccttccaacccgaaccagtccatgggtaattacaacacttattcatttcctcagcacatgatgcctccgcaaagcgttccgagtcaagtcggtttacctggaggaccaccacatggtcctctagggcagcaaccagctcataatactgctttaggccctccgcccggctttcctcaaggagtaacttcgaattcttcactgcctaatggcgccccgcagtttgtaggacacggcgtatcgtctcaacatatgatgggcggcggacaacctggcttgcctcccaattctccgaatacccaacagggaatacctcaacatcagggcgggattccccataatcagggtggaatgatgccccctcaaggtggactgccgccgcagcagggtgggattcccatgcaaggaggaatttctcagaatcaaaattttccgcatcaaggacagatgtcgccccaatttcagcagcctggagctccaccggctagtccacaagtcaaaacaaatggagaggcacaaactgcagagttaataagttttgattag

SEQ ID NO: 612 - DNA, 2160 bp, Psylliodes chrysocephala; identical to SEQ ID NO: 611
  misc_feature: Vps27

SEQ ID NO: 613 - DNA, 2160 bp, Psylliodes chrysocephala; identical to SEQ ID NO: 611
  misc_feature: Vps27

SEQ ID NO: 614 - DNA, 2160 bp, Psylliodes chrysocephala; identical to SEQ ID NO: 611
  misc_feature: Vps27

SEQ ID NO: 615 - DNA, 2160 bp, Psylliodes chrysocephala; identical to SEQ ID NO: 611
  misc_feature: Vps27

SEQ ID NO: 616 - DNA, 2160 bp, Psylliodes chrysocephala; identical to SEQ ID NO: 611
  misc_feature: Vps27

SEQ ID NO: 617 - DNA, 2160 bp, Psylliodes chrysocephala; identical to SEQ ID NO: 611
  misc_feature: Vps27

SEQ ID NO: 618 - DNA, 2160 bp, Psylliodes chrysocephala; identical to SEQ ID NO: 611
  misc_feature: Vps27

SEQ ID NO: 619 - DNA, 2160 bp, Psylliodes chrysocephala; identical to SEQ ID NO: 611
  misc_feature: Vps27

SEQ ID NO: 620 - DNA, 2160 bp, Psylliodes chrysocephala; identical to SEQ ID NO: 611
  misc_feature: Vps27

SEQ ID NO: 621 - DNA, 2160 bp, Psylliodes chrysocephala; identical to SEQ ID NO: 611
  misc_feature: Vps27

SEQ ID NO: 622 - DNA, 2730 bp, Psylliodes chrysocephala
  misc_feature: COPI Beta Prime
aatctcaaaatgccacttcgtttagacataaaaagaaggctaacagcccgttctgaccgggtaaaatgtgtagacctccatcctacagaaccctggatgctctgctccctttacagcggaaacataaacgtctggaatcatgaaaatcagcaactcgttaaaacttttgaagtatgtgatctgccagtgagagctgcaaaatttgtaccaagaaaaaattggattgtcagtggatctgatgatatgcagataagggtttttaattataataccctagatagagttcatgcctttgaagcgcattctgattatgttagatccattgttgtacatcctacacagccatatattctaacaagtagtgatgatatgcttatcaaattatggaattgggaaaaagcatgggcctgccaacaggtgtttgaaggccacatccattatattatgcaaatttccataaaccctaaagacaacaacacctttgccagtgcttctttagacaggaccataaaagtctggcaattgggtgcttccactgcaaatttcactctcgaaggtcatgaaaaaggagtaaactgtgttgattattaccatggaggtgataaaccatacctaatatctggtgcagatgatagattagtcaaaatttgggattaccagaataaaacttgtgtccaaactttagaaggacatggacaaaacgttactgctgtttgtttccatcctgaactcccaatagctcttactggaagtgaagatggtactatcagagtttggcatgcaaatactcacagattagaaagcagtttgaactatggctttgaaagagtatggactattttctgcttgaagggttccaataatgttgctttaggttatgatgagggtagcattttggtgaaagttggtagagaggaaccagctgttagtatggatgcaagtggtggaaaaattatttgggctagacattcagaattgcagcaggctaacctcaaggctcttccagagggtgctgaaattagggatggtgaacgccttccagtttctgtgaaagatatgggtgcatgtgacatctacccacaaactatccagcacaatccaaatggtcgtttcgtggtagtttgtggagatggagaatacatcatttacacagctatggcattaaggaacaaagcttttggaagtgcccaagagtttgtgtgggctcaagattcaagtgaatatgctatcagggaatctggatctacaattagaatatttaaaaatttcaaagaaaagaagaatttcaaatctgattttggtgctgaaggtatatttggaggctaccttctgggtgtaaaatctgtttctggattgactttctatgattgggaaactttggatttggttagaagaattgaaatacaaccacgggcaatatattggtctgacagtggcaaattagtttgcttggccactgaagatagttattttatactctcatatgattctgatgaagtacaaagggccaaagacaataatcaggttgctgatgatggagttgaatcggcttttaatctcttgggtgaaattaatgagtctgtacgtactggtctatgggtaggagattgtttcatttacacaaattctgtaaaccgtataaattactttgttggaggtgaacttgtaacaatagcccatctagatggaccactttatgttcttggttatgtccctaaagatgacaggctttatttagtagacaaagaactaagagtagttagctaccagctccttctttcagtcttagaatatcaaactgctgtgatgaggagagatttttcaactgctgatagagtcttgccttctattccaaaagagcatagaaccagagtggcacatttcttagaaaagcaaggttttaagcaacaagctttggcagttagttcagatcctgaacatagatttgaactagcagttgcactagaagatctaaacacagccagagccttagctcaggaagctaataaccctcagaaatggagccaacttgccgaacttgcagcttctacgaacaatctagaattagccaaagaatgtatgcagaaggctcaagattacggagggttgctacttttagctactagctcaggagatgaaaaagtagtaagggcgctaggggatgccactcaaacagaaggcaaacataatctatctttcttgtctcatttcttagttggcgatttaaataaatgtctgaatatattgataacaactggaagacttccagaagcagctttctttgcgaggtcttacttacctgataaaatctcagaagtggtagatctctggagaacacagttgtctactatcaatcagaaagcaggacaaagcttggcagatcctaaagattatgaaaatctgtttcctggtcttcaagaagcaatagtagcacagaaatttttggaacaaaataaccctggatttactccagcaatgttagcaaccagtatcaccccaaatcatgaaagaaacgttatagctgaggtggaagcccagtcgaagaatagtggagtaactgggagttcttctcaatattctgtgaaggcacctattgagcaattgaagaaactctcaattgatcaagatgatgatgacgacgacatagatttagacctggatggtgtgaatatagatgaaaatatagacacaacggatatcaacatagatgacgatttgttgagcgattga

SEQ ID NO: 623 - DNA, 2730 bp, Psylliodes chrysocephala; identical to SEQ ID NO: 622
  misc_feature: COPI Beta Prime

SEQ ID NO: 624 - DNA, 2730 bp, Psylliodes chrysocephala; identical to SEQ ID NO: 622
  misc_feature: COPI Beta Prime

SEQ ID NO: 625 - DNA, 2730 bp, Psylliodes chrysocephala; identical to SEQ ID NO: 622
  misc_feature: COPI Beta Prime

SEQ ID NO: 626 - DNA, 2730 bp, Psylliodes chrysocephala; identical to SEQ ID NO: 622
  misc_feature: COPI Beta Prime

SEQ ID NO: 627 - DNA, 2730 bp, Psylliodes chrysocephala; identical to SEQ ID NO: 622
  misc_feature: COPI Beta Prime

SEQ ID NO: 628 - DNA, 2730 bp, Psylliodes chrysocephala; identical to SEQ ID NO: 622
  misc_feature: COPI Beta Prime

SEQ ID NO: 629 - DNA, 2730 bp, Psylliodes chrysocephala; identical to SEQ ID NO: 622
  misc_feature: COPI Beta Prime

SEQ ID NO: 630 - DNA, 2730 bp, Psylliodes chrysocephala; identical to SEQ ID NO: 622
  misc_feature: COPI Beta Prime

SEQ ID NO: 631 - DNA, 2730 bp, Psylliodes chrysocephala; identical to SEQ ID NO: 622
  misc_feature: COPI Beta Prime

SEQ ID NO: 632 - DNA, 2730 bp, Psylliodes chrysocephala; identical to SEQ ID NO: 622
  misc_feature: COPI Beta Prime

SEQ ID NO: 633 - DNA, 1140 bp, Psylliodes chrysocephala
  misc_feature: Actin 5c
cctatcaaaatgtgtgaagaagaagttgccgctttagttgtagacaatggatccggtatgtgcaaggccggtttcgccggggatgacgcgccccgtgccgtattcccatccatcgtcggacgcccaagacatcagggtgtaatggtaggaatgggacaaaaagactcttacgtaggagatgaagcccaaagcaaaagaggtatcctcacattgaaataccccattgaacacggtatcatcaccaactgggatgatatggaaaagatctggcatcacaccttctacaacgaactccgtgtcgccccagaagaacaccccgtcctcctgacagaagctccactcaaccccaaggcaaacagagaaaagatgacccaaatcatgtttgaaaccttcaacacacccgccatgtatgtagccatccaagccgtactttccctgtacgcttccggtcgtaccacaggtatcgtattggactccggagatggtgtcacccacaccgtaccaatctacgaaggttacgcccttccccacgccatcctccgtttggacttggctggtcgtgatttgaccgactacctcatgaaaatcttgaccgaaagaggttactcattcaccaccacagctgaaagagaaatcgtccgtgacatcaaggagaaactttgctatgtcgccctcgacttcgaacaggaaatggccaccgctgccgcttcaacctctttggaaaagagctacgaacttcccgatggacaggtcatcaccatcggtaacgagagattccgttgtccagaagccctcttccaaccttccttcttgggtatggaatcttgcggtatccacgaaaccgtctacaactccatcatgaagtgtgacgttgatatccgtaaggacttgtacgccaacaccgtactttccggaggtaccaccatgtaccctggtatcgccgacaggatgcaaaaagaaatcaccgccttggctccaagcaccatcaagatcaagatcatcgcacccccagaaaggaaatactccgtatggatcggtggatccatcttggcttccctgtccaccttccaacagatgtggatctccaaacaggaatacgacgaatccggccctggaattgtccaccgcaagtgcttctaa

SEQ ID NO: 634 - DNA, 1140 bp, Psylliodes chrysocephala; identical to SEQ ID NO: 633
  misc_feature: Actin 5c

SEQ ID NO: 635 - DNA, 1140 bp, Psylliodes chrysocephala; identical to SEQ ID NO: 633
  misc_feature: Actin 5c

SEQ ID NO: 636 - DNA, 1140 bp, Psylliodes chrysocephala; identical to SEQ ID NO: 633
  misc_feature: Actin 5c

SEQ ID NO: 637 - DNA, 1140 bp, Psylliodes chrysocephala; identical to SEQ ID NO: 633
  misc_feature: Actin 5c

SEQ ID NO: 638 - DNA, 1140 bp, Psylliodes chrysocephala; identical to SEQ ID NO: 633
  misc_feature: Actin 5c

SEQ ID NO: 639 - DNA, 1140 bp, Psylliodes chrysocephala; identical to SEQ ID NO: 633
  misc_feature: Actin 5c

SEQ ID NO: 640 - DNA, 1140 bp, Psylliodes chrysocephala; identical to SEQ ID NO: 633
  misc_feature: Actin 5c

SEQ ID NO: 641 - DNA, 1140 bp, Psylliodes chrysocephala; identical to SEQ ID NO: 633
  misc_feature: Actin 5c

SEQ ID NO: 642 - DNA, 3687 bp, Psylliodes chrysocephala
  misc_feature: COPI Alpha
cggaagaacaccttgaaaatgttaacgaaattcgaaaccaaatctgctagggtaaaagggctgtcttttcaccccaaaagaccttggattttggcaagtttgcataacgggtgtatccagttatgggactaccgtatgtgcacccttttggaaaagtttgacgagcatgatggacctgtgagagggatatgttttcatagtcaacaacctctatttgtatcaggtggtgatgattataagataaaggtgtggaactacaagcaaaaacgatgtatttttacgttattgggtcatttagattacattcgtaccacaatgttccatcatgagtatccttggattgtgtctgcatctgatgatcagactataagaatttggaattggcaatcaaggacttgcatttgtgtcctcacaggtcacaatcattatgtcatgtgtgctacattccatccaactgatgatttattagtttctgcttcattggattctacagttagggtctgggatatttcaggtctgcgtaagaagaatgtagctccaggacctgcaggtcttgaagagcatctcaagaatcctggttcaactgatttatttggacaagctgatgctgtagttaagcatgttttagagggacatgaccgtggtgtaaactgggcttcatttcatcctacacttcctttaatagcctctggggcagatgataggcaaatcaaactgtggagaatgaatgattcgaaagcttgggaggtggatacatgcaggggacattacaataatgtctcttgtgtattattccatcccaggcaagagctgctactatcaaatggtgaagataggagtatcagggtttgggatatggctaaaaggacgtgtttgcatacttttagaagggaacatgaacgtttttgggtcatgaccagtcatcctaatctgaatttattcgctgctggacatgatggtggaatggtcatcttcaagctagaaagagaacgcccagcttatacggtacacggcaacctgctgtactacgtaaaagaacggtttttgagaaaactcgactttaccacgtccaaagacgtgcccgttatgcaaatcaggggcggaggtaaaattccggtatacagaatgtcttttaatcccgcagaaaatgccgttctactttcgacgcgcacttccaatttggataacagcacttacgatctgtacatgattcccaaagatcaagaacgcgaagatcacgttccagaggcagaaagtaagagatcctctggtttgacggctctttgggtggcgagaaaccgtttcgctgtcttagataggacccaccaattgatcatcaagaatttaaagaacgaagtcaccaaaaaggtccaaactcccacgtgcgatgaagttttttatgccggcaccggcatgctactgcttagagattcggaacacgtaacgttgttcgacgtacaacagaaaaggactttggctcaagttaaaataaataaatgcagatacgtggtctggtcatcggatatgtcgcacttggcgcttctctccaaacataatgtgacagtttgtaatagaaaattagacgtcctgtgctctttacacgaaaatactcgagtaaaatcaggagcttgggacgatagcggtgtatttatctatactaccagcaatcacatcaagtatacccttaaaaacggcgatcacggaatcatcagaacactcgatcttcctatatacataactagagtgaggggaagtcaagtgttttgcttggatagggaatgcaagccgcgtctattggtcatcgatccaaccgaatacaaattcaaactggctttaatcaaccacaaatacgaagaagtcttgtacatggttagaaattcgcgattggttggtcagagcatcatttcttacttgcaacaaaaaggttatcctgaggtggcgttgcatttcgtcaaagacgacaagacgcgattcacgttggctctggagtgcggcaacatcgagatagctttggaggcggctaaagcgctcaacgataagaattgttgggatcagctggcacaagcagcgctgtggcagggcaatcatcaagtcgtcgaaatgtgctaccaacgcaccaagagtttcgagaaattgtctttcctgtatttgatcaccggcaatttggaaaagttgagaaaaatgatgaaaatcgctgaaattcgcaaggccaggtcgtctcaataccacgctgcgcttttattgggcgatcttgaggaaagagtgaaggtcttgaaggcctcgaaccagctgtctttggcatatttgacagccgccacccatggaatgagagaagaagccgatcagttaaaagaacaaataggagacacgaaaaaggtaccggatgtggatccgaacgccaaattcttgaaacccccaccgccgatacagcaagccgagtccaactggcctttgttgactgttagcaggagcttcttcgaaaacaccgcagccgtagctacagcttcggccaacatgaaatctttaatggccgaaccgatatccgacgtagcaatggaggaagcccaaggttggggcgatgatgacgagctggagctcgatcccgacgagaagaaacccgacactgcggccgccggtggtgacggtgaagctggttgggacgtcgaagacgaaggattggaaatacccgatctaggaccgacggcaacggccgaagtcgagggtaatttcgtccatctacccacaccaggtccgtctccgcctttaacttggactaaaaactctcaactggtggccgatcacgtagcggcaggttctttcgaatcggctgctagattgcttcacgatcagctgggcgtggtagatttcaagcctttcgaaagtctcttcttgaacctctacagcacgtccaagacagtttcttcttggcaacaaaacgtcccaccttcgttcagttatcctttgaggaattggaaggaggcgaatatcaagaatcaattgcctgcttccggggtcaaattgaacgatttggtcgctaaattgcagatctgttatcaattgacgacgggcggaaagttcacggaggccatcgaaaaactacaaactctgctgttgtccgtcagccttttggtcgtcgacaacaaacaggagattacggaagcccagcaattgctgagaatagccagcgagtacatttgcggactgcaaatggaaactttgcgcaaaaccatgccgaaaacgtcgcctgaagagcagaaacgtcagtgcgagatggccgcttacttcacgcactgcaaattacagcccatccatcaaatcctgaccctcaggaccgctttgaacatgtttttcaagctcaaaaactataaaaccgcagcttcgttcgccaaaagacttctggaactgggtcctagaccggaagtcgcgcagcaggctaggaaaatcctgcaggcctgcgattccaatctgacggacgatattcaactgcattacgacgagcacaatccattcaatttgtgcggtcattcgtacacgccgatatacaggggcaaagcggaggagaagtgtccgttgtgcggtaccagctacttgcctaaattcaaaggagtgttgtgtaatatttgtaaggtagctgaggtcggtaaggatacgattggattgagaataagtacccaccagtttagatag

SEQ ID NO: 643 - DNA, 3687 bp, Psylliodes chrysocephala; identical to SEQ ID NO: 642
  misc_feature: COPI Alpha

SEQ ID NO: 644 - DNA, 3687 bp, Psylliodes chrysocephala; identical to SEQ ID NO: 642
  misc_feature: COPI Alpha

SEQ ID NO: 645 - DNA, 3687 bp, Psylliodes chrysocephala; identical to SEQ ID NO: 642
  misc_feature: COPI Alpha

SEQ ID NO: 646 - DNA, 3687 bp, Psylliodes chrysocephala; identical to SEQ ID NO: 642
  misc_feature: COPI Alpha

SEQ ID NO: 647 - DNA, 3687 bp, Psylliodes chrysocephala; identical to SEQ ID NO: 642
  misc_feature: COPI Alpha

SEQ ID NO: 648 - DNA, 3687 bp, Psylliodes chrysocephala; identical to SEQ ID NO: 642
  misc_feature: COPI Alpha

SEQ ID NO: 649 - DNA, 3687 bp, Psylliodes chrysocephala; identical to SEQ ID NO: 642
  misc_feature: COPI Alpha

SEQ ID NO: 650 - DNA, 3687 bp, Psylliodes chrysocephala; identical to SEQ ID NO: 642
  misc_feature: COPI Alpha

SEQ ID NO: 651 - DNA, 3687 bp, Psylliodes chrysocephala; identical to SEQ ID NO: 642
  misc_feature: COPI Alpha

SEQ ID NO: 652 - DNA, 3687 bp, Psylliodes chrysocephala; identical to SEQ ID NO: 642
  misc_feature: COPI Alpha

SEQ ID NO: 653 - DNA, 1146 bp, Psylliodes chrysocephala
  misc_feature: VATPase D
atatcatatgacatttggggtgaggtgttttcatctcgtgagtttttttgtacagttcttcgtacttctccaagacaacttacaaaatcaactacaatcatgaagggctgtctttacaacatcgacaacggatatttagaaggattatgtcgtggattcaagtgcggaatcctgaaacaaagcgactatctaaatttagttcagtgcgagacccttgaagatttgaaactgcatttacaaggtaccgattacggaactttcttggctaacgagccctcgcccttggcggtgtcgaccatcgactccagattgagggaaaaacttgtgatcgagtttcagcatatgcgtaatcaagccgtagagcctctgtctaccttcttggacttcattacctacagttatatgattgacaatattattctgttgattactggaacattgcatcaaagacctattggtgaactgattccaaaatgtcatccattaggcagctttgaacaaatggaagctatacacgtagccgcaacgccagcagagttatacaacgctgtcttagtagacacgccgctggctccattctttgtagattgcatcagcgaacaggatttggacgaaatgaacatcgaaatcatcagaaacactttgtacaaggcctacttggaagcgttctggactttttgcaaggcaatcggtggaaccacggctgattccatgtgcgaaattttggcgttcgaagctgatagacgagctatcatcattacgattaactctttcggtacggagcttagcaaggacgatagagctaaattgtatccacgttgcggaagactgcatcccgatgggttagctgctctggctagagctgaggattacgagcaggtcaaagctattgccgagtattatgctgagtattctaagctgtttgaaggcgccggaaacaatcccggcgataaaactttggaggataagttcttcgagtacgaggtgcgtctcaacatcaacgctttcatgcagcagttccactttggggtgttttattcatacttgaaactcaaggagcaggagtgcaggaatattgtatggatttccgagtgcgtggctcaaaaacacagagccaagattgataattacatccctattttctaa

SEQ ID NO: 654 - DNA, 1146 bp, Psylliodes chrysocephala; identical to SEQ ID NO: 653
  misc_feature: VATPase D

SEQ ID NO: 655 - DNA, 1146 bp, Psylliodes chrysocephala; identical to SEQ ID NO: 653
  misc_feature: VATPase D

SEQ ID NO: 656 - DNA, 1146 bp, Psylliodes chrysocephala; identical to SEQ ID NO: 653
  misc_feature: VATPase D

SEQ ID NO: 657 - DNA, 1146 bp, Psylliodes chrysocephala; identical to SEQ ID NO: 653
  misc_feature: VATPase D

SEQ ID NO: 658 - DNA, 1146 bp, Psylliodes chrysocephala; identical to SEQ ID NO: 653
  misc_feature: VATPase D

SEQ ID NO: 659 - DNA, 1146 bp, Psylliodes chrysocephala; identical to SEQ ID NO: 653
  misc_feature: VATPase D

SEQ ID NO: 660 - DNA, 1146 bp, Psylliodes chrysocephala; identical to SEQ ID NO: 653
  misc_feature: VATPase D

SEQ ID NO: 661 - DNA, 1146 bp, Psylliodes chrysocephala; identical to SEQ ID NO: 653
  misc_feature: VATPase D

SEQ ID NO: 662 - DNA, 972 bp, Psylliodes chrysocephala
  misc_feature: COPI Epsilon
aacaagaagatgaaaaattatttaaacgtcacacgtcacacaaacgtcataacaaaaatggcacgtcagcagcaagacgtagacgaacttttcgaaataaaaaattatttctatataggaaactaccagcaatgtatcaacgaagctcaaaaattaaaaaagccctcaactccagaagttgctacccaaagagatatcttcacttatagatcctacatggcacaaaataagtttttggtggtattagatgaaattcatggagcatctccgatcgaaattcaaccactgaaactattagctgattatctatcaggaaaaaataataaagaagcagtggtagcccaagttgaccaacaagtagccacaaatgccaataatgacactctgattttggttgctgccactatttacgtcaatgaaggcaatctggagggagcatataaagtattacatgcgtcagaatgtttggaagcacatgcttttattattgacattcttttgaagttggacagggtagatttggctaagaagaaattaaaagaaatgcaagataaagacgatgatgctactttaactcaactggcacaggcttggatcaacattcaaactggtggtgataaacttcaagatgcttactacatttaccaagaattggttgacaaatatggttcaacaccacttcttctgaacggtcaagctgtcacatttataggtcaagcaaaatatgaagaggcagaggcagctttgcaagaggctatcgataaagatgccaattatccagatacattggttaattttattacccttcagaggcatatgggcaaaggtcctgagattgcaaacagatatttatcccagttgaaggacgccaatcctgaacatccttacataaaggatttgaggcaaaaagaaagtgagtttcaaaggattactcaacaatattcgccatctgtaactagcattcctgcataa

SEQ ID NO: 663 - DNA, 972 bp, Psylliodes chrysocephala; identical to SEQ ID NO: 662
  misc_feature: COPI Epsilon

SEQ ID NO: 664 - DNA, 972 bp, Psylliodes chrysocephala; identical to SEQ ID NO: 662
  misc_feature: COPI Epsilon

SEQ ID NO: 665 - DNA, 972 bp, Psylliodes chrysocephala; identical to SEQ ID NO: 662
  misc_feature: COPI Epsilon

SEQ ID NO: 666 - DNA, 972 bp, Psylliodes chrysocephala; identical to SEQ ID NO: 662
  misc_feature: COPI Epsilon

SEQ ID NO: 667 - DNA, 972 bp, Psylliodes chrysocephala; identical to SEQ ID NO: 662
  misc_feature: COPI Epsilon

SEQ ID NO: 668 - DNA, 972 bp, Psylliodes chrysocephala; identical to SEQ ID NO: 662
  misc_feature: COPI Epsilon

SEQ ID NO: 669 - DNA, 972 bp, Psylliodes chrysocephala; identical to SEQ ID NO: 662
  misc_feature: COPI Epsilon

SEQ ID NO: 670 - DNA, 972 bp, Psylliodes chrysocephala; identical to SEQ ID NO: 662
  misc_feature: COPI Epsilon

SEQ ID NO: 671 - DNA, 972 bp, Psylliodes chrysocephala; identical to SEQ ID NO: 662
  misc_feature: COPI Epsilon

SEQ ID NO: 672 - DNA, 972 bp, Psylliodes chrysocephala; identical to SEQ ID NO: 662
  misc_feature: COPI Epsilon

SEQ ID NO: 673 - DNA, 1584 bp, Psylliodes chrysocephala
  misc_feature: COPI Delta
aataataatattttagtaaatttgtgccatttaaacgaaattacaatggtactaattgcagcagcagtctgcacgaaagcaggcaaaacaattgtatctagacagtttgttgaaatgaccaaagcacgtattgaaggtctactagctgctttcccaaagttaattccaactgggacacaacacacttttgttgaaacagattcagtgcgttacgtgtatcaacctttagaaagactatacatgttgctcatcacaactagagctagtaatatattagaagatctggagaccctacgtctatttgcaagagttattccagaatattgtaggtctttagatgaaaatgaaatagctgaaaatgccttttctcttatatttgcttttgatgaaattgtagctctaggttatagggaaagtgtcaatctgtctcaaatccgcacttttgtcgaaatggattcacatgaagaaaaagtttatcaagctgttagacagactcaagaaagagaggcaaagaacaagatgagagaaaaggctaaagaattgcaaaggcagaaaatggaagcacaaaagaagggtggcaaacctgcgttcagcaacagcggtggttttggtagttccaccggttatactccgacgccatctattggagatatcgctaaccaggtcaacgatgttaagccgccttcatatacagccacccctgcacaaaaacctcgtggtatgaaactaggcggaaagggtagagatgtggaatcttttgtggatcaattgaaatctgaaggagaaaacgtcataactccaaataaaaacagcatctcgcaaccaggaactaaagcacctgctattaaaactgatattgatgacgtccacttgagattggaagagaaactgatcgccagaatgggtcgtgatggaggagtgcaacaattcgaaatattaggcatggcgacgttgcacataggcgatgatagatggggcagaatacgagtccaattagaaaatcagaatgctcatggtgttcaactccaaacccatccaaatgtcgataaggagctattcaagttacgatcgcagattggtctgaagcagccctcaaagcctttccccatccacactgacgttggtgtgctaaaatggcgattgcagagcacagatgaagccttagtgcctctattaatcaactgttggccctcagaagctggcgacggcagttgtgacgtcaacatcgaatacgaacttgcccacatcaatttggaattggtcgatgtcaatattacaattccattgccaatcggttgctcgcccatagtaggcgaatgtgatggtacatacacacatgaagctaaaagaaatcatctggtttggaatttgccgcttattgacgctagtaacaagactgggtcgttagaattcaatgcaccgagagccattcccaatgatttcttcccgctgtcggtcggattcaattccaaatcatcctacgctagtattaagataaccgaagtagtccttgtcgatgatgattctcctattaaatattccgtggagactgcactctatccagaaaaatacgaagtagtgtaa

SEQ ID NO: 674 - DNA, 1584 bp, Psylliodes chrysocephala; identical to SEQ ID NO: 673
  misc_feature: COPI Delta

SEQ ID NO: 675 - DNA, 1584 bp, Psylliodes chrysocephala; identical to SEQ ID NO: 673
  misc_feature: COPI Delta

SEQ ID NO: 676 - DNA, 1584 bp, Psylliodes chrysocephala; identical to SEQ ID NO: 673
  misc_feature: COPI Delta

SEQ ID NO: 677 - DNA, 1584 bp, Psylliodes chrysocephala; identical to SEQ ID NO: 673
  misc_feature: COPI Delta

SEQ ID NO: 678 - DNA, 1584 bp, Psylliodes chrysocephala; identical to SEQ ID NO: 673
  misc_feature: COPI Delta

SEQ ID NO: 679 - DNA, 1584 bp, Psylliodes chrysocephala; identical to SEQ ID NO: 673
  misc_feature: COPI Delta

SEQ ID NO: 680 - DNA, 1584 bp, Psylliodes chrysocephala; identical to SEQ ID NO: 673
  misc_feature: COPI Delta

SEQ ID NO: 681 - DNA, 1584 bp, Psylliodes chrysocephala; identical to SEQ ID NO: 673
  misc_feature: COPI Delta

SEQ ID NO: 682 - DNA, 1191 bp, Psylliodes chrysocephala
  misc_feature: Rpn9
tttttgtcttgtcattcatattcacaaaaaatggctgcagctgcggtgcaaccgtctaatattagtgattatctatctaaaaaacaacaagaaagtccaaaagaattaggttccgaatgggccgaactcgaggaacttcataataaaaaattatggcatcaattaacattaaaattactcgtttttattaaaaaaccggaattacaaaaaggcgacaacctaattcaactttatcacaatttcattcaatccttcgaaaataaaatcaatcctttgtctttggttgaaatagcggctattgtcgtcgaacaatataaagaacctaaggatgcaatcactttcttagagaagactgaacctaaagttaaaatcaatccagatgcacaaaatctctgcaaagttttggagggccaaatttatctcgaaaagttaaacgatttagatgccaccaaaaagattatagaggaagtcgaagccactctagacaacgcagatggagttacacctgtgcatggcaggttttatttactggcctctcaatattatcgaattcaaggggaccatgcacaatattacagaactgccttgaggtatttgggttgcatagagctggacactttaaaatccgatgtcaaagtacaacatgcattttttttgggattggcagctctgttgggcgaaggtgtgtacaatcttggagaattactggctcaccctgtgttagactctttgaaatcaacagaaaatgcttggttaattgaacttttgtatgctttcaattctggtgacataaagagatttgaagctatgaaaacacaatgggctggcatagcagatctagctgctgaggagctctttttgagacaaaagatatctttgttgtgtctgatggagatgacctttagcagaccatctcacaacagacaactaacttttgctgaaatttcaaaagaaactaaattacctcttaatgaaattgaacttctggtcatgaaggcactttctcaaggtctcgttaaaggtgctattgatcaggttgccagtactgtaaatatgacatgggtccaacctagagttttggacaagactcaaatatccagcatggtatccagacttagtctgtggtgcacacatgtcaatactatggaacagttattagaagaaaaagcaagtgaaatattaactttgtag

SEQ ID NO: 683 - DNA, 1191 bp, Psylliodes chrysocephala; identical to SEQ ID NO: 682
  misc_feature: Rpn9

SEQ ID NO: 684 - DNA, 1191 bp, Psylliodes chrysocephala; identical to SEQ ID NO: 682
  misc_feature: Rpn9

SEQ ID NO: 685 - DNA, 1191 bp, Psylliodes chrysocephala; identical to SEQ ID NO: 682
  misc_feature: Rpn9

SEQ ID NO: 686 - DNA, 1191 bp, Psylliodes chrysocephala; identical to SEQ ID NO: 682
  misc_feature: Rpn9

SEQ ID NO: 687 - DNA, 1191 bp, Psylliodes chrysocephala; identical to SEQ ID NO: 682
  misc_feature: Rpn9

SEQ ID NO: 688 - DNA, 1191 bp, Psylliodes chrysocephala; identical to SEQ ID NO: 682
  misc_feature: Rpn9

SEQ ID NO: 689 - DNA, 1191 bp, Psylliodes chrysocephala; identical to SEQ ID NO: 682
  misc_feature: Rpn9

SEQ ID NO: 690 - DNA, 1191 bp, Psylliodes chrysocephala; identical to SEQ ID NO: 682
  misc_feature: Rpn9

SEQ ID NO: 691 - DNA, 1191 bp, Psylliodes chrysocephala; identical to SEQ ID NO: 682
  misc_feature: Rpn9

SEQ ID NO: 692 - DNA, 1191 bp, Psylliodes chrysocephala; identical to SEQ ID NO: 682
  misc_feature: Rpn9

SEQ ID NO: 693 - DNA, 690 bp, Psylliodes chrysocephala
  misc_feature: Vps24
agaaaaacatctgtaataaacatgggactttttgggaagacacctgaaaggaatcctaaagatttggttacagaatggaatcacaaacttcgcaaagagggataccaattagataggcaaattaaagctatacaaagagaagaggaaaaagtgaaaaggtctttaaaagatgcagcgaagaaaaacgacaaggacacctgccttattttggccaaggaaattattaattcaaggaaagctgttaataaaatttacacgtcgaaggctcacctcaattctgtgatgttgcaaatgaagaaccagttagctacattgagagtgtcaggcgccctccagaagtctacagaggtgatgcaagcgatgcagcgactcgttagagtgcccgaggtagcccaaacaatgcaagacatgtcgaaagagatgatgaaggcgggtataatcgaagaaatgttggacgaaaccatggaagaccttgattattccgaggaaatggaggaggcggcgcagacggagatcgacaaagttttgttcgagataacggagggaaagataggagaagcccctctgccgcctcaagacgccgcagagaaagtatcgccgttaccagcgacctctgtggaggaaccggaagaggaggacgaagaagagattacggaaatgcagagtcgattagcggcgctcaaatcctaa

SEQ ID NO: 694 - DNA, 690 bp, Psylliodes chrysocephala; identical to SEQ ID NO: 693
  misc_feature: Vps24

SEQ ID NO: 695 - DNA, 690 bp, Psylliodes chrysocephala; identical to SEQ ID NO: 693
  misc_feature: Vps24

SEQ ID NO: 696 - DNA, 690 bp, Psylliodes chrysocephala; identical to SEQ ID NO: 693
  misc_feature: Vps24

SEQ ID NO: 697 - DNA, 690 bp, Psylliodes chrysocephala; identical to SEQ ID NO: 693
  misc_feature: Vps24

SEQ ID NO: 698 - DNA, 690 bp, Psylliodes chrysocephala; identical to SEQ ID NO: 693
  misc_feature: Vps24

SEQ ID NO: 699 - DNA, 690 bp, Psylliodes chrysocephala; identical to SEQ ID NO: 693
  misc_feature: Vps24

SEQ ID NO: 700 - DNA, 2574 bp, Psylliodes chrysocephala
  misc_feature: Vps16A
atatattacaattattttcctttaatttttatcaaaatgtctgctgcaatgctaacggcagaatggttcttactgggaagagatgcatattacagaaaatttgaaatatattctatgtcatggcatcaagaagttaatatagagaattatatagcatcttcggcttcttacggaggccctatagccattagaagagatgaccaaaagattcttaaagtgcaggggtctggacaaccaattatttccattttttctggatctggcaaacagatagcttcattcaagtggagtagacggcccattgttcacatgggctggacaaatgatgaagaacttctttgtatacaagaagatggtatggtagtcaaacatgacatgtttggaaagtatcttcatacatttagcataagccaaaaggttcaagattccaaagttgttgatgctaaaatttttaccagtcctcaaaatttcactggcatcgctgtaatgacgtctaatttcaaaatatttgttgttaataacatcaatgatccaaaaacaagacaattgtctgaacttccaagatcaggaattcaacctactagctgggctatagtttctgatgataagactgaagttttaatagcaagaagtgtagaactctatagactgaaacaagatgaacaccacacaagtgcaatgcttgaaccggatatcaccaacaaatacacatcaatcataaaaatgtctgtttcattaaatgcacaccatctggcgttgtttacggattctggatttttgtggttgggttccacaaatttgaggacaaaatactgcgaaatcgattgtgacatggtttttagaccaaaacatttactttggtgtggtaatgaggctgttgttctgtattgggaaaaagacaacacttttttaatagttggtaaacacggtcaaaaattaagttacttttatgatggatcggttcatttggtaccagaaatagatggtattaggataatttcgaatacgcaacatgaactacttcaaaaagtaccagaagttgttcaaaagatttttagaattaacagcacagaccctggtagttttctgttagaagcctcaaaacaatttcaaaaaggtagccataaagcaaatgaatacatttgtttagttaaaaatgatctggagactgcagtcaaccagtgtatagaagcagtaggatatgaatttgacactgacgttcaaaaattgttaataagagcagcacaatttggtaaatgcttcattccagacatgagatctgatagttatgtaaatatgtgtagacttttgagagtattgaatgctgtcagagaccccaaagtggggatacccattactattacacagttaaattacatgaaaagaaggaagcaagacatactgaagcggcttataacaaggaattattattatttggctttacaaattgccaaatacttgaaattaccagaggaagacggaacaagctatattttggtccactgggcaaaatataaggtcagccagtcacatttagaggaagaaacggtagctagggaaattgctgaaaagttggggtactcttcaggcatttcttacagtgaaattgccagtactgcttcagaatatgggagaaaaaaattggctataaagcttctagattacgagtctaaagcaagcgaccaagtaaaactgcttttagaattaggagaaaacgtaccagcgttagttaaggcgattgaaagtggagatacagatttagtgtatatggttatattgaaattaagagaaaatatgccgttgggagactttaagatgactattagaaattttcctgtagctcaatccctgtttattaaatactgcaaagagcataatacccaagctttaagtgaaatatacattcaagaagatgatttctgcgcccaagccgagatgtttatccttgacagtttagacgataagaaaaatcacatgaaagacgcccttctcacctcggcattggaggcttacaaaaaaggtcgcaaagatttatatgtctcaatgtgcgacgaatcaataaaattaattcgtttccaacgagacgtagaggataaagtaccaaacgcaaaaaataaatttatcggaaaatccgtacaagatacttgcaaaacattgctagaaatgaaagagacgaaattggccgagaagtttaaaaacgatttcaaaatacccgatagaagatactggtggttgaaaataaacagtttggccaaacacaacgattggatcgagttggaaaaattctcgaaattaaagaaatcccctataggatatgcgccgtttgtggacgtttgtttgcagcacgataaacgccaggaagctctcaaatatttacctaaagttagcgaggacataaaggttaaatattgcatcaaagcagcgtgcttagaagaagcagcagatatagcttaccatcagagagacatgcagagtcttctgtatgtccaaagcaaatgtggaaaccaatttgctcagaatcaattagctgaaaaaataaatacaatgataatgcagctggattctaaaaaataa

SEQ ID NO: 701 - DNA, 2574 bp, Psylliodes chrysocephala; identical to SEQ ID NO: 700
  misc_feature: Vps16A

SEQ ID NO: 702 - DNA, 2574 bp, Psylliodes chrysocephala; identical to SEQ ID NO: 700
  misc_feature: Vps16A

SEQ ID NO: 703 - DNA, 2574 bp, Psylliodes chrysocephala; identical to SEQ ID NO: 700
  misc_feature: Vps16A

SEQ ID NO: 704 - DNA, 2574 bp, Psylliodes chrysocephala; identical to SEQ ID NO: 700
  misc_feature: Vps16A

SEQ ID NO: 705 - DNA, 2574 bp, Psylliodes chrysocephala; identical to SEQ ID NO: 700
  misc_feature: Vps16A

SEQ ID NO: 706 - DNA, 2574 bp, Psylliodes chrysocephala; identical to SEQ ID NO: 700
  misc_feature: Vps16A

SEQ ID NO: 707 - DNA, 2574 bp, Psylliodes chrysocephala; identical to SEQ ID NO: 700
  misc_feature: Vps16A

SEQ ID NO: 708 - DNA, 2574 bp, Psylliodes chrysocephala; identical to SEQ ID NO: 700
  misc_feature: Vps16A

SEQ ID NO: 709 - DNA, 2574 bp, Psylliodes chrysocephala; identical to SEQ ID NO: 700
  misc_feature: Vps16A

SEQ ID NO: 710 - DNA, 2574 bp, Psylliodes chrysocephala; identical to SEQ ID NO: 700
  misc_feature: Vps16A

SEQ ID NO: 711 - DNA, 414 bp, Psylliodes chrysocephala
  misc_feature: RpL40
gcacgttgcggaacaccaccttccacaatgcaaattttcgtgaaaactctcacaggtaaaaccattaccctcgaggtagagccatcagatactatagaaaatgtaaaagcaaagatccaggacaaggaaggtatccctcctgaccagcagcgattaatcttcgctggaaaacaactcgaagatggacgtactctttcagactataatatccagaaagaatccacccttcatttggtgctccgtttgagaggaggtatcatcgagccctctctgcgtctcctagctcagaaatacaactgcgacaagatgatctgtcgcaaatgctatgctaggttacaccctagggctactaattgcaggaaaaccaagtgtggacacacaaacaacttgcgccccaagaagaagctgaagtaa

SEQ ID NO: 712 - DNA, 414 bp, Psylliodes chrysocephala; identical to SEQ ID NO: 711
  misc_feature: RpL40

SEQ ID NO: 713 - DNA, 414 bp, Psylliodes chrysocephala; identical to SEQ ID NO: 711
  misc_feature: RpL40

SEQ ID NO: 714 - DNA, 1254 bp, Psylliodes chrysocephala
  misc_feature: RpL3
ttctactttgagatgtctcacagaaagttcagtgcaccacgtcacggatctatggggttctaccccaagaaaaggtcgcaaaggcatcgtggaaaggtaaaggctttccctaaggatgatccctcgaaacctgtccatttaaccgcttttatcggttataaagctggtatgacccacgttgtaagagaagcagacaggcccggttcaaaaataaataagaaagaaatcgtagaggctgttaccattttggaaactcctccaatggttgttgtaggagtagttggttatattgaaactccacatggtcttagggctttggccacagtttgggctgagcatttatctgaagactgtcgcagacgcttctacaagaactggtacaagagcaaaaagaaggccttcactaaggcatctaagaaatggactgatgatctaggtaagaagtccattgaacgcgacttgaagaagatcattaagtactgcaaggttgtcagggtggttgctcacactcagatgaaattgttgaaacaacgtcaaaagaaagcccacatcatggaaattcaacttaacggtggaaccgtagccgataaggttgcatgggccagggaacatcttgaaaaaccaatccctgttgccaacgtctttgcccaagatgagatgattgactgcattggtgtcaccaagggtcatggatacaaaggtgttacttctcgttggcacacaaagaagttgccccgcaaaacgcacaagggtcttcgtaaagttgcttgtattggagcgtggcatccttctcgtgtatcgttcaccgtagcccgtgctggtcagaaaggttaccatcacagaactgagatgaacaagaagatttacagaatcggagccggaatccacaccaaagatggaaaggtcgtcaagaacaatgcttccactgcttatgatcttagtgagaaaaccattactccaatgggaggtttccctcactatggtgaagtgaacaatgacttcgtcatgatcaagggatgttgtataggacccaagaagcgtgtcatcaccctcagaaagtccttgttggtccacaccaaacgtgtcgctttggagaagatcaatttgaaattcattgatacctcgtctaaatttggacacggtagattccagaccgccgccgataaggccgccttcatgggtccgctcaagaaggatagagttaaggaagaagataagaccgccgcacccgctgcggcagcagtttccagttag

SEQ ID NO: 715 - DNA, 1254 bp, Psylliodes chrysocephala; identical to SEQ ID NO: 714
  misc_feature: RpL3

SEQ ID NO: 716 - DNA, 1254 bp, Psylliodes chrysocephala; identical to SEQ ID NO: 714
  misc_feature: RpL3

SEQ ID NO: 717 - DNA, 1254 bp, Psylliodes chrysocephala; identical to SEQ ID NO: 714
  misc_feature: RpL3

SEQ ID NO: 718 - DNA, 1254 bp, Psylliodes chrysocephala; identical to SEQ ID NO: 714
  misc_feature: RpL3

SEQ ID NO: 719 - DNA, 1254 bp, Psylliodes chrysocephala; identical to SEQ ID NO: 714
  misc_feature: RpL3

SEQ ID NO: 720 - DNA, 1254 bp, Psylliodes chrysocephala; identical to SEQ ID NO: 714
  misc_feature: RpL3

SEQ ID NO: 721 - DNA, 1254 bp, Psylliodes chrysocephala; identical to SEQ ID NO: 714
  misc_feature: RpL3

SEQ ID NO: 722 - DNA, 1254 bp, Psylliodes chrysocephala; identical to SEQ ID NO: 714
  misc_feature: RpL3

SEQ ID NO: 723 - DNA, 1254 bp, Psylliodes chrysocephala; identical to SEQ ID NO: 714
  misc_feature: RpL3

SEQ ID NO: 724 - DNA, 1254 bp, Psylliodes chrysocephala; identical to SEQ ID NO: 714
  misc_feature: RpL3

SEQ ID NO: 725 - DNA, 1317 bp, Psylliodes chrysocephala
  misc_feature: Vps4
gttcaaatggctacgggaactactttacaaaaagctatagaactagtaactaaagccaccgaagaggataggaataaaaattatgaagaagctcttcgtttgtatgaacatggtgtagaatattttcttcatgccataaagtatgaagctcagggagaaaaggctaaggaaagtattagggctaagtgtgtacaatatctagaaagggctgaaaaaattaaagaatctataaggaaaactaaaaagaagccagtattagatggaggctcctccaaagaagacaaaaagagtgatagtgatgaagatgacgatcctgataaaaagaagctacaaagcaaactagaaggtgctatagttgttgaaaaacctcacgtgaaatggacagatgtagctggattggaagctgctaaagaagcccttaaggaagctgtaattttaccaatcaagtttccacatcttttcagtggaaagagagtaccttggaaaggtattttgttgtttgggccacctggtactggtaaatcttatttagccaaagctgttgcgaccgaagccaataattccactttcttctcggtgtcctcttctgatttagtctcaaaatggttgggtgaatctgagaaattggtcaagaacttgttcgagttggccagaactcacaaacccagcatcatattcattgacgaaatcgattcactttgttcgtcacgttctgataatgaatctgaatcagccaggagaatcaagacggaatttttagttcaaatgcaaggtgttggccatgataccgagggtatcttagtgttaggagctactaatattccttgggtattagattccgccatcaggagacgtttcgaaaaaaggatttacataccgctaccggaagaaccggcgagagctgtcatgttcaaattacatttaggaaatacccacacagagttgacagaagaagacatcaaagagttggcttccaaaactgaaggttactctggtgctgatattagtatcgtggtacgtgacgctctgatgcagccagtgcgtaaagttcaaaccgcgacccactttaagaggattaggggaccatcaccagtcgatcccaataccatagtggatgatttactcataccttgctcgcccggtgattctggtgcaatagaaatgtcctggatggatattccgagcgaaaaattagcagagccaccggttactttgaatgacatgttgagatcagttggcacctcgaagcccaccgtcaatgatgaggatcttacgaaattgaggaagtttatggaagatttcggacaagaaggatag

SEQ ID NO: 726 - DNA, 1317 bp, Psylliodes chrysocephala; identical to SEQ ID NO: 725
  misc_feature: Vps4

SEQ ID NO: 727 - DNA, 1317 bp, Psylliodes chrysocephala; identical to SEQ ID NO: 725
  misc_feature: Vps4

SEQ ID NO: 728 - DNA, 1317 bp, Psylliodes chrysocephala; identical to SEQ ID NO: 725
  misc_feature: Vps4

SEQ ID NO: 729 - DNA, 1317 bp, Psylliodes chrysocephala; identical to SEQ ID NO: 725
  misc_feature: Vps4

SEQ ID NO: 730 - DNA, 1872 bp, Psylliodes chrysocephala
  misc_feature: VATP-A/Vha68-2
ggttgcaatagatacataacatccacaaaaatgtctagagtccgggttggagacgaagaaaaagagggccagtatggatatgtccatgccgtgtccggtccagtcgtcactgctgaaaaaatgtctggatctgctatgtacgaattagtacgtgtagggtactatgagcttgtaggagaaattattcgattggagggtgatatggcaactatccaggtatatgaagaaacttctggtgtaacagtcggcgaccctgtattgagaaccggcaaacctctatcagtagaacttggacctggtattatgggttccatttttgatggtattcaacgtcctctaaaggacattaacgacttaactcaaagtatttacattccgaaaggtgtaaatgttccagcactttccagaacggcaaagtgggaattcgcacccatcaacatcaagttgggatctcatttgaccggcggtgacatctatggtatggttcatgaaaacactcttgtgaagcttaaaatgactcttccacctaaagctaagggaactgtaacatatgttgcagacccaggaaattacacagttgatgaagttgtattggaaactgaatttgatggagaacgcacaaaatacaccatgttgcaagtgtggccggtacgtcaagccagacctgttagtgaaaaattgccggccaatcatcccctacttaccggacaacgtgtattggatgccctcttcccttgtgttcagggcggtactactgctattcccggtgcctttggttgtggaaaaactgtaatttcacagtcgctctccaaatactccaattctgatgtcattgtctacgtaggttgtggagaaagaggtaatgaaatgtctgaagtattgcgggacttccctgaattgacggtagaaatcgacggcgcgaccgaatctatcatgaaacgtaccgccttagtagccaacacttcaaacatgcccgtagccgcccgtgaggcctccatctatacgggtatcacgctatcagagtacttccgtgatatgggttacaatgtatccatgatggccgattccacctcccgttgggccgaagccttgagagaaatttcaggtcgtttggccgagatgcccgccgattccggttatccggcctatttgggagcccgtttggcctctttctacgaacgtgctggtcgcgttaagtgtttgggtaatcccgacagggagggttccgtgtccatcgtcggcgctgtgtctccccctggtggtgacttttcagatcccgtcacatctgctactcttggtatcgtacaagtattttggggtttggataagaaacttgcacaacgtaagcacttcccctctgtcgattggctcagttcatattccaaatatttgagggcattggacgatttctatgacaaaaactttgccgaattcataccccttagaactaaagttaaggaaattcttcaggaagaagacgatctcacagaaatcgtgcaactagtaggaaaagcatcgttggccgaagctgacaaaatcactttggaaatcgccaagctgttgaaagaagatttcctccaacaaaactcctactcgtcctacgatcgtttttgcccgttctacaaaaccgtcggaatgctcaagaacatgatcggcatgtacgacatggctagacacgccgtagaatcgacggctcagtccgagaacaagatcacgtggaacgtgatcagggattcgatgagcaacattttgtaccaattgagcagtatgaagtttaaagatcccgttaaagacggcgaagcgaaaatcaaagccgattttgaccagctgtatgaagatatccaacaggcattcagaaatctagaagattaa

SEQ ID NO: 731 - DNA, 1872 bp, Psylliodes chrysocephala; identical to SEQ ID NO: 730
  misc_feature: VATP-A/Vha68-2

SEQ ID NO: 732 - DNA, 1872 bp, Psylliodes chrysocephala; identical to SEQ ID NO: 730
  misc_feature: VATP-A/Vha68-2

SEQ ID NO: 733 - DNA, 1872 bp, Psylliodes chrysocephala; identical to SEQ ID NO: 730
  misc_feature: VATP-A/Vha68-2

SEQ ID NO: 734 - DNA, 1872 bp, Psylliodes chrysocephala; identical to SEQ ID NO: 730
  misc_feature: VATP-A/Vha68-2

SEQ ID NO: 735 - DNA, 1872 bp, Psylliodes chrysocephala; identical to SEQ ID NO: 730
  misc_feature: VATP-A/Vha68-2

SEQ ID NO: 736 - DNA, 1872 bp, Psylliodes chrysocephala; identical to SEQ ID NO: 730
  misc_feature: VATP-A/Vha68-2

SEQ ID NO: 737 - DNA, 1872 bp, Psylliodes chrysocephala; identical to SEQ ID NO: 730
  misc_feature: VATP-A/Vha68-2

SEQ ID NO: 738 - DNA, 1872 bp, Psylliodes chrysocephala; identical to SEQ ID NO: 730
  misc_feature: VATP-A/Vha68-2

SEQ ID NO: 739 - DNA, 1872 bp, Psylliodes chrysocephala; identical to SEQ ID NO: 730
  misc_feature: VATP-A/Vha68-2

SEQ ID NO: 740 - DNA, 1872 bp, Psylliodes chrysocephala; identical to SEQ ID NO: 730
  misc_feature: VATP-A/Vha68-2

SEQ ID NO: 741 - DNA, 2244 bp, Psylliodes chrysocephala
  misc_feature: sec6
cagcaatattatttaaaaatgggtgcaaaaaaagtaaatatgagagagctagaagcagctgctaaagcgtctgctactactaaagtgataaatacattgaataggccaggacaattagaaaaaattgaccaaataaaacaacgatatgttcgaaaaaaagcttcagttgaagcattgctgaagtcagcaatgcagcaacagctagatggtgttagaattggtttgaatcaactacacaggtgtctcgaagaagtatctgaaattaatattagtatgaaaaagatgtcagacttattttctgatgtaccagagcttagtaaggtactctgtgatattagagatgaaaatatgaggcattcgcaatatgtaacagccaaagaaaatctgaaacatatttttacagtcccagaaagtgtagaaaagacaaaatcctggattaatgaaggaaagttacttcatacacatcagtgcttgagagacttggaaaattcaagagatgacttactatttgagcttcacaaattacctaaccaatctgtacatgataaatcaatgttaaaagcatattttgctgatgtagaagtactatccagcttactagaaaaacagttaactattattttatatagaacattaaatactgtaagaaaagatcctacagtaatagttactgcattgagaattattgaaagggaggaaaaagcagatgaagaagctctgaaacaacagagacaaactgggtttatccctcctggtcgtcctaaaaagtggaaagagatggcttttagcattattgagaaaacagtatcttcaaaaattgaaggtactcaagttgaggaaagagaagataataaacactggctgataagatatttagaacttattagaatgatgattttagaagatttaagaattgtcaaaactctttgcttaccgtgctttcctccaagttataaaatattagataaatatattcatatctaccatggatgcctttccgtacatctgcaggaaattatacaaaatggccttcaaggtaatgaatatgttacaatgctgtcttgggttcttaaaacttatcgagccaaagacatgttaggtcaccctgatttagtgacctctactgaaaatttacctcctttacttccatctgctgttatagacagattagaagaagactatcttaagaatattgaagcgaactatagtgaatggatgcaaaatactcttaaatcagaaaaagaggaatggaggatgaatactgaaccttattcagagtcatattctcgtacgccagccccaattattatttttcaaatgatagatcagaatttacaagtaaccaaaacaataagtgaagagctaacatttaaatgcttgaatttaagcattagacaagttataatattcgcagatgctttcagggatgctattattgaatttaagaacaaatattttgaggacaggaaacaagtcgtttatttcacccagtatatgattttaatagtaaataatactttacaacttgtggagttggggtgtcaattagaaaaacagtatgttactaataacagttcacatgaacttaccaagaattttggcatgttaaaaagtacttatattaaattgaggaatgacgcagtcatgtacttgctagaagaactttttgtagacatagaccaacattttgataaattgttcacatcacattggttcccaactaaccctgccgacacaatctatgttacaatagaagattatttccaagattacaaccgattagctgaagcgaactacaaatatgcagtggaattattattaaccctagtgggtagaaaatatcttacagctatgctgtctaggcgcatatctttcaaaactttcgatgaatgcatgaaagctgcccaaaaagtttcggaagaagccaatagattcaacaaactctttgaaaatctcagtaatgatatagaatgcgagaacccatttgatgccatcattatgctctctgaagtgctgaaaagcgatgatgacatgttatcctttgagctacatagggtggttgaaaagtatcctgatattactgatgatcatcttttaagactgctgaacctgagaggagacctgtcaagatcagatgtcagagataaagttgtgcatgtagataagcctaaagttctgcataagagcacagtgtttaagaccctggtgtttcctaagcttgtaaatattaatttaactttctag

SEQ ID NO: 742 - DNA, 2244 bp, Psylliodes chrysocephala; identical to SEQ ID NO: 741
  misc_feature: sec6

SEQ ID NO: 743 - DNA, 2244 bp, Psylliodes chrysocephala; identical to SEQ ID NO: 741
  misc_feature: sec6

SEQ ID NO: 744 - DNA, 2244 bp, Psylliodes chrysocephala; identical to SEQ ID NO: 741
  misc_feature: sec6

SEQ ID NO: 745 - DNA, 2244 bp, Psylliodes chrysocephala; identical to SEQ ID NO: 741
  misc_feature: sec6

SEQ ID NO: 746 - DNA, 2244 bp, Psylliodes chrysocephala; identical to SEQ ID NO: 741
  misc_feature: sec6

SEQ ID NO: 747 - DNA, 2244 bp, Psylliodes chrysocephala; identical to SEQ ID NO: 741
  misc_feature: sec6

SEQ ID NO: 748 - DNA, 2244 bp, Psylliodes chrysocephala; identical to SEQ ID NO: 741
  misc_feature: sec6

SEQ ID NO: 749 - DNA, 2244 bp, Psylliodes chrysocephala; identical to SEQ ID NO: 741
  misc_feature: sec6

SEQ ID NO: 750 - DNA, 2244 bp, Psylliodes chrysocephala; identical to SEQ ID NO: 741
  misc_feature: sec6

SEQ ID NO: 751 - DNA, 2244 bp, Psylliodes chrysocephala; identical to SEQ ID NO: 741
  misc_feature: sec6

SEQ ID NO: 752 - DNA, 2244 bp, Psylliodes chrysocephala; identical to SEQ ID NO: 741
  misc_feature: Rpn3

SEQ ID NO: 753 - DNA, 2244 bp, Psylliodes chrysocephala; identical to SEQ ID NO: 741
  misc_feature: Rpn3

SEQ ID NO: 754 - DNA, 2244 bp, Psylliodes chrysocephala; identical to SEQ ID NO: 741
  misc_feature: Rpn3

SEQ ID NO: 755 - DNA, 2244 bp, Psylliodes chrysocephala; identical to SEQ ID NO: 741
  misc_feature: Rpn3

SEQ ID NO: 756 - DNA, 2244 bp, Psylliodes chrysocephala; identical to SEQ ID NO: 741
  misc_feature: Rpn3

SEQ ID NO: 757 - DNA, 2244 bp, Psylliodes chrysocephala; identical to SEQ ID NO: 741
  misc_feature: Rpn3

SEQ ID NO: 758 - DNA, 2244 bp, Psylliodes chrysocephala; identical to SEQ ID NO: 741
  misc_feature: Rpn3

SEQ ID NO: 759 - DNA, 2244 bp, Psylliodes chrysocephala; identical to SEQ ID NO: 741
  misc_feature: Rpn3

SEQ ID NO: 760 - DNA, 2244 bp, Psylliodes chrysocephala; identical to SEQ ID NO: 741
  misc_feature: Rpn3

SEQ ID NO: 761 - DNA, 2244 bp, Psylliodes chrysocephala; identical to SEQ ID NO: 741
  misc_feature: Rpn3

SEQ ID NO: 762 - DNA, 2244 bp, Psylliodes chrysocephala; identical to SEQ ID NO: 741
  misc_feature: Rpn3

SEQ ID NO: 763 - DNA, 1533 bp, Psylliodes chrysocephala
  misc_feature: VATPase B
gtttttgtggtttgtgacagacgtatctttccttcagagaagatgtcttacccttcgacgttaaatgcaaaacaggcctcacgggaacatattttggctgtttccagagattttgtatctcagcccagactcacttataaaacggtatctggtgtcaatggtccactggtaattctggaagatgtaaagttcccaaaattcaacgaaattgtccaacttagattggctgatggaactttaagatctggtcaagttttggaagtcagtgggaataaagctgtagtacaagtatttgaaggcacctcaggaattgatgccaaaaacacagtatgtgaattcactggtgatattctcagaactccagtatctgaggatatgttgggtagagtgttcaacggatctggaaaaccaattgataaaggtcccccaattttggcagaagattacttagatatccaaggtcaacctatcaacccatggtcacgtatttatcctgaagaaatgatccaaactggtatctccgccatcgacgtaatgaactccattgcccgtggccaaaaaattcccattttctcggccgctggtctgcctcacaacgaaattgctgctcaaatttgtcgacaagccggtcttgtcaaaattcccggcaaatctgtattggatgaccatgaagataactttgctattgtgtttgctgctatgggagttaacatggaaactgctaggtttttcaaacaagatttcgaagaaaatggttccatggaaaatgtatgtctgtttttgaacttggctaatgatcccactattgaaagaattattacaccacgtttggctcttacagcagctgaatttttggcctaccaatgcgaaaaacacgtcctggtcatattgactgatatgtcttcatatgctgaagctttgcgtgaggtatccgccgccagagaagaagtgcccggtcgtcgtggtttcccaggttacatgtacaccgatttggccaccatttacgaacgtgccggtcgtgtcgaaggtcgtaacggttccattacgcagattcccatcttgactatgcctaacgacgatattacccatccaattcccgatttgacaggttatattaccgagggacagatctacgtagaccgtcaattgcacaataggcaaatctatcctccagtcaatgtattgccctctttgtctcgtttgatgaaatccgccattggtgagggtatgaccaggaaagatcactctgacgtttctaaccaactgtatgcctgttacgctatcggtaaggatgtccaagctatgaaagccgtagtaggagaggaagctcttacacctgacgatctcctgtacttggaattcttaacgaaattcgaaaagaacttcatcactcagggtaactacgaaaaccgtaccgttttcgaatcattggacatcggttggcaactactccgtatcttccccaaggaaatgttgaaacgtatcccagccagtatattggccgaattctatcccagagactcgcgtcattag

SEQ ID NO: 764 - DNA, 1533 bp, Psylliodes chrysocephala; identical to SEQ ID NO: 763
  misc_feature: VATPase B

SEQ ID NO: 765 - DNA, 1533 bp, Psylliodes chrysocephala; identical to SEQ ID NO: 763
  misc_feature: VATPase B

SEQ ID NO: 766 - DNA, 1533 bp, Psylliodes chrysocephala; identical to SEQ ID NO: 763
  misc_feature: VATPase B

SEQ ID NO: 767 - DNA, 1533 bp, Psylliodes chrysocephala; identical to SEQ ID NO: 763
  misc_feature: VATPase B

SEQ ID NO: 768 - DNA, 1533 bp, Psylliodes chrysocephala; identical to SEQ ID NO: 763
  misc_feature: VATPase B

SEQ ID NO: 769 - DNA, 1533 bp, Psylliodes chrysocephala; identical to SEQ ID NO: 763
  misc_feature: VATPase B

SEQ ID NO: 770 - DNA, 1533 bp, Psylliodes chrysocephala; identical to SEQ ID NO: 763
  misc_feature: VATPase B

SEQ ID NO: 771 - DNA, 1533 bp, Psylliodes chrysocephala; identical to SEQ ID NO: 763
  misc_feature: VATPase B

SEQ ID NO: 772 - DNA, 717 bp, Psylliodes chrysocephala
  misc_feature: Proteasome alpha 2
tcattagaaataatggcatccgaacgttatagtttttctttaactacttttagcccttccggtaaattagttcaaattgaatatgccttagcggctgtagcggcaggcgcaccatcagtaggaattaaagcatgtaatggagttgtaatagctacagaaaacaaacataaatcaattctttatgatgaacacagcgttcacaaagttgaaatgattaccaaacacattggaatggtttattctggcatgggaccagattaccgtttgctagtaaaacaagcgcgtaaaatggcccaacaatattaccttgtgtatcaggaacctattcctacagtgcaattggttcagagagtagcagcagtaatgcaagagtatacccaatctggaggtgtcagaccttttggtgtttctttattgatctgtggatgggacaataataggccttatttattccagtgtgatccttctggagcctattttgcttggaaagctactgctatgggcaaaaattatgttaatgggaaaactttcttggaaaaaaggtacagtgaagaattggaattagacgatgctgtacacactgcaattttaacattaaaagaaagtttcgagggccagatgacagctgataacattgaagttggaatttgcgatgaatcaggtttcagaaggttcgatccttctacagtgaaggactttttggcaaatatcccttaa

SEQ ID NO: 773 - DNA, 717 bp, Psylliodes chrysocephala; identical to SEQ ID NO: 772
  misc_feature: Proteasome alpha 2

SEQ ID NO: 774 - DNA, 717 bp, Psylliodes chrysocephala; identical to SEQ ID NO: 772
  misc_feature: Proteasome alpha 2

SEQ ID NO: 775 - DNA, 717 bp, Psylliodes chrysocephala; identical to SEQ ID NO: 772
  misc_feature: Proteasome alpha 2

SEQ ID NO: 776 - DNA, 717 bp, Psylliodes chrysocephala; identical to SEQ ID NO: 772
  misc_feature: Proteasome alpha 2

SEQ ID NO: 777 - DNA, 717 bp, Psylliodes chrysocephala; identical to SEQ ID NO: 772
  misc_feature: Proteasome alpha 2

SEQ ID NO: 778 - DNA, 717 bp, Psylliodes chrysocephala; identical to SEQ ID NO: 772
  misc_feature: Proteasome alpha 2

SEQ ID NO: 779 - DNA, 717 bp, Psylliodes chrysocephala; identical to SEQ ID NO: 772
  misc_feature: Proteasome alpha 2

SEQ ID NO: 780 - DNA, 717 bp, Psylliodes chrysocephala; identical to SEQ ID NO: 772
  misc_feature: Proteasome alpha 2

SEQ ID NO: 781 - DNA, 717 bp, Psylliodes chrysocephala; identical to SEQ ID NO: 772
  misc_feature: Proteasome alpha 2

SEQ ID NO: 782 - DNA, 717 bp, Psylliodes chrysocephala; identical to SEQ ID NO: 772
  misc_feature: Proteasome alpha 2

SEQ ID NO: 783 - DNA, 642 bp, Psylliodes chrysocephala
  misc_feature: Vps20
gatctcgacatgggtataatattcggcaaaaagaaaaagcccagtagagttactgaacaagacaaagcaatattacaactaaaacagcaaagagacaaactaaaacagtatcaaagaagaatagaactatctcttgttaaagacaaggaattagctaagaaactattaaacaatggccaaaaagaaagagcaaaactgctcctcaaaaagaaacgataccaagaacagattctgtccaaactagatggtcaactaagcaacttagaaagtatggctagtgatatagaatttgcccaagttgaagtacaggtagtagaaggtcttaaaacaggaaatgaagctctgaaaaaagtcaatgctgctctaaatattgaagatattgaacgtatattagacgaaacaagagagggagtagacaaacaaaatgaaatcaatgaactgcttagtggccagttgactgatgaagatgaggctgctgtagaggacgaactagcagctattattagtgaagagatgcctgcagtgccttctcaagagcctgaagtacaggccaatgaatctgccgaggaggatgaaaaagatcaggagattgtcaaaaagccaaaagagaaagaaaaagagaacattcctgttttggcttaa

SEQ ID NO: 784 - DNA, 642 bp, Psylliodes chrysocephala; identical to SEQ ID NO: 783
  misc_feature: Vps20

SEQ ID NO: 785 - DNA, 642 bp, Psylliodes chrysocephala; identical to SEQ ID NO: 783
  misc_feature: Vps20

SEQ ID NO: 786 - DNA, 642 bp, Psylliodes chrysocephala; identical to SEQ ID NO: 783
  misc_feature: Vps20

SEQ ID NO: 787 - DNA, 642 bp, Psylliodes chrysocephala; identical to SEQ ID NO: 783
  misc_feature: Vps20

SEQ ID NO: 788 - DNA, 642 bp, Psylliodes chrysocephala; identical to SEQ ID NO: 783
  misc_feature: Vps20

SEQ ID NO: 789 - DNA, 642 bp, Psylliodes chrysocephala; identical to SEQ ID NO: 783
  misc_feature: Vps20

SEQ ID NO: 790 - DNA, 642 bp, Psylliodes chrysocephala; identical to SEQ ID NO: 783
  misc_feature: Vps20

SEQ ID NO: 791 - DNA, 602 bp, Psylliodes chrysocephala
  misc_feature: RpL19
caatgagttccttaaaacttcaaaagaggctggcagcctctgttatgagatgtggtaagaagaaagtatggttggatcctaatgaaatcaatgagattgccaatacaaattccagacaaaatattcgtaaattgatcaaggatggtcttattattaagaaacctgtagcggtacattcacgtgcccgcgtacgtaagaacaccgaagctcgtagaaaggggaggcactgcggttttggtaaaaggaaaggtactgctaatgcccgtacaccccaaaaggaattatggatccagcgcatgcgcgttttgcgtcgattattaaaaaaatatcgggaagcgaaaaagattgacagacatctataccactcactgtacatgaaggctaagggtaatgtattcaagaacaaacgtgttcttatggaatacattcacaaaaagaaggctgagaaggcacgtgctaagatgttagcagatcaagctaatgccaggagaatgaaggtgaaacaagctagagaaagacgggaagaacgtattgctacaaagaagcaagaagtgttgcagaactaccagagggaagatgaagcagcagccgctaagaaataa

SEQ ID NO: 792 - DNA, 602 bp, Psylliodes chrysocephala; identical to SEQ ID NO: 791
  misc_feature: RpL19

SEQ ID NO: 793 - DNA, 602 bp, Psylliodes chrysocephala; identical to SEQ ID NO: 791
  misc_feature: RpL19

SEQ ID NO: 794 - DNA, 602 bp, Psylliodes chrysocephala; identical to SEQ ID NO: 791
  misc_feature: RpL19

SEQ ID NO: 795 - DNA, 602 bp, Psylliodes chrysocephala; identical to SEQ ID NO: 791
  misc_feature: Rpt6

SEQ ID NO: 796 - DNA, 602 bp, Psylliodes chrysocephala; identical to SEQ ID NO: 791
  misc_feature: Rpt6

SEQ ID NO: 797 - DNA, 602 bp, Psylliodes chrysocephala; identical to SEQ ID NO: 791
  misc_feature: Rpt6

SEQ ID NO: 798 - DNA, 602 bp, Psylliodes chrysocephala; identical to SEQ ID NO: 791
  misc_feature: Rpt6

SEQ ID NO: 799 - DNA, 602 bp, Psylliodes chrysocephala; identical to SEQ ID NO: 791
  misc_feature: Rpt6

SEQ ID NO: 800 - DNA, 602 bp, Psylliodes chrysocephala; identical to SEQ ID NO: 791
  misc_feature: Rpt6

SEQ ID NO: 801 - DNA, 602 bp, Psylliodes chrysocephala; identical to SEQ ID NO: 791
  misc_feature: Rpt6

SEQ ID NO: 802 - DNA, 602 bp, Psylliodes chrysocephala; identical to SEQ ID NO: 791
  misc_feature: Rpt6

SEQ ID NO: 803 - DNA, 602 bp, Psylliodes chrysocephala; identical to SEQ ID NO: 791
  misc_feature: Rpt6

SEQ ID NO: 804 - DNA, 602 bp, Psylliodes chrysocephala; identical to SEQ ID NO: 791
  misc_feature: Rpt6

SEQ ID NO: 805 - DNA, 602 bp, Psylliodes chrysocephala; identical to SEQ ID NO: 791
  misc_feature: Rpt6

SEQ ID NO: 806 - DNA, 602 bp, Psylliodes chrysocephala; identical to SEQ ID NO: 791
  misc_feature: COPI Gamma

SEQ ID NO: 807 - DNA, 602 bp, Psylliodes chrysocephala; identical to SEQ ID NO: 791
  misc_feature: COPI Gamma

SEQ ID NO: 808 - DNA, 602 bp, Psylliodes chrysocephala; identical to SEQ ID NO: 791
  misc_feature: COPI Gamma

SEQ ID NO: 809 - DNA, 602 bp, Psylliodes chrysocephala; identical to SEQ ID NO: 791
  misc_feature: COPI Gamma

SEQ ID NO: 810 - DNA, 602 bp, Psylliodes chrysocephala; identical to SEQ ID NO: 791
  misc_feature: COPI Gamma

SEQ ID NO: 811 - DNA, 602 bp, Psylliodes chrysocephala; identical to SEQ ID NO: 791
  misc_feature: COPI Gamma

SEQ ID NO: 812 - DNA, 602 bp, Psylliodes chrysocephala; identical to SEQ ID NO: 791
  misc_feature: COPI Gamma

SEQ ID NO: 813 - DNA, 602 bp, Psylliodes chrysocephala; identical to SEQ ID NO: 791
  misc_feature: COPI Gamma

SEQ ID NO: 814 - DNA, 602 bp, Psylliodes chrysocephala; identical to SEQ ID NO: 791
  misc_feature: COPI Gamma

SEQ ID NO: 815 - DNA, 602 bp, Psylliodes chrysocephala; identical to SEQ ID NO: 791
  misc_feature: COPI Gamma

SEQ ID NO: 816 - DNA, 602 bp, Psylliodes chrysocephala; identical to SEQ ID NO: 791
  misc_feature: COPI Gamma

SEQ ID NO: 817 - DNA, 1011 bp, Psylliodes chrysocephala
  misc_feature: Rpn8
acgggctttaaaatgcctagttcagacgtaacgacaactaaagttatagtccatccattggtcttacttagcgtagtggatcatttcaatcgtatgggaaaaatcggtaaccaaaaacgcgtcgtcggtgtcttactcggttgttggagggctaaaggagtcttggatgtttcgaatagtttcgcagttccttttgatgaggatgacaaagatcaatctgtgtggtttttggaccatgattacttagaaaatatgtacggcatgtttaaaaaagtcaatgctagagaacgtgtagtgggctggtaccacaccggacccaaattacaccaaaacgacattgctattaatgaactagtaagaagatactgtccaaattcagtattggtaattattgatgccaaaccaaaagacttaggccttcccacagaagcgtatcaagccgttgaggaagtacatgatgatggttcaccaacatccaaaacttttgaacacgtaccaagcgaaattggagcagaagaggctgaagaagtgggtgtagaacatttattacgtgatatcaaagatactactgttggcacactttctcaaagaattacaaatcaattgttgggtctgaagggactgcattcacagttgaaagacattagagactatttgttaaatgtttgtgacaatacgctacctattaatcatcaaattatctatcagttacaagatattttcaatttgctgcctgatataaaccaagatgcttttaacaattcattttatgttaaaaacaatgatcagatgcttgtagtctacttagcagctctggttagatccatagtggcattgcataatttaatcaataacaaactgacaaacaaagatgctgaggagggtaagaaagaagagaagaaggatagtaaggataaagataaggacagtaaggataaggatagtaaagataaagataaggaaaagggagaaaaggataaggatgcaaagaaggatgagaagaaaaagtag

SEQ ID NO: 818 - DNA, 1011 bp, Psylliodes chrysocephala; identical to SEQ ID NO: 817
  misc_feature: Rpn8

SEQ ID NO: 819 - DNA, 1011 bp, Psylliodes chrysocephala; identical to SEQ ID NO: 817
  misc_feature: Rpn8

SEQ ID NO: 820 - DNA, 1011 bp, Psylliodes chrysocephala; identical to SEQ ID NO: 817
  misc_feature: Rpn8

SEQ ID NO: 821 - DNA, 1011 bp, Psylliodes chrysocephala; identical to SEQ ID NO: 817
  misc_feature: Rpn8

SEQ ID NO: 822 - DNA, 1011 bp, Psylliodes chrysocephala; identical to SEQ ID NO: 817
  misc_feature: Rpn8

SEQ ID NO: 823 - DNA, 1011 bp, Psylliodes chrysocephala; identical to SEQ ID NO: 817
  misc_feature: Rpn8

SEQ ID NO: 824 - DNA, 705 bp, Psylliodes chrysocephala
  misc_feature: VATP-E/Vha26
aatcgtttctacaaatcaaccaaaatggctttaagtgacgcagatgtccaaaaacagatcaaacatatgatggctttcattgagcaagaagccaatgaaaaagctgaagaaatcgatgctaaggctgaggaggagttcaacatcgagaagggacgtctcgttcaacaacagaggctcaaaattatggaatattatgaaaagaaggaaaagcaggtcgaattacaaaagaaaatccaatcttccaacatgttgaaccaggcaaggttgaaggttctaaaagtgagagaagatcatgtccgtgctgttttagaagaagcccgtaaacgtctaggcgaagtcaccaaagaccaaggaaaatatggtcagattattgaaagcttgattctccaaggattgtaccagctctttgaaaaagaggtgaccgtcagagtgcgtccacaagatagagaattggtaaaatcgatcttgaacaatgtccaaaccaaatacaaggatatcacaggcaaagacatagtcttgaaaatcgatgatcagtcccatctatctcaagaaaccaccggaggaattgaactccttgccttgaggaacaagatcaagattaacaatactttggaagctcgtttggagctcatttcccaacagttggtacctcagattcgtaacgccctgttcggacgcaacgtcaacagaaaattcactgattaa

SEQ ID NO: 825 - DNA, 705 bp, Psylliodes chrysocephala; identical to SEQ ID NO: 824
  misc_feature: VATP-E/Vha26

SEQ ID NO: 826 - DNA, 705 bp, Psylliodes chrysocephala; identical to SEQ ID NO: 824
  misc_feature: VATP-E/Vha26

SEQ ID NO: 827 - DNA, 705 bp, Psylliodes chrysocephala; identical to SEQ ID NO: 824
  misc_feature: VATP-E/Vha26

SEQ ID NO: 828 - DNA, 705 bp, Psylliodes chrysocephala; identical to SEQ ID NO: 824
  misc_feature: VATP-E/Vha26

SEQ ID NO: 829 - DNA, 705 bp, Psylliodes chrysocephala; identical to SEQ ID NO: 824
  misc_feature: VATP-E/Vha26

SEQ ID NO: 830 - DNA, 2328 bp, Psylliodes chrysocephala
  misc_feature: sec23A
attcaaaaaatgagtacttacgaagaatacattcaacaaaacgaagaccgagatggaatcagatttacttggaatgtatggccatcgagtaggatagaagcaactcgtttggtagtaccattagcgtgtctttatcaaccgattaaagaacgtttagatcttccacccatacagtatgatcccgttctgtgtacaagaaataactgcagagcgattttaaatcctatgtgccaagttgattatcgagcaaaattgtgggtttgcaatttttgttttcaacgcaatccgtttccacctcaatatgcagctatttctgaacagcatcaacctgctgagttaatgcctatgttttcaactattgagtatactattactagagctcagtgtttaccaccgatattcttgtatgttgttgatacttgcatggatgaggaagaattgggttcacttaaagattctttacaaatgtcactcagtttattgcctccgaatgctttaattggtttgattacatttggaaaaatggtccaagttcatgaattaggtactgagggttgcagtaaatcatacgtctttagaggtactaaagatttaacagctaagcaagttcaagagatgttgggtattggtaaagttgctatggggcctcaacaacaaccaggtcaacctagacctggtcaaatgcaacctgcacctatcgcgccaggtagcagattcctacagcctgtatctaaatgcgatatgaatttaactgatttaataggagagcagcaaaaagatccctggcctgttcatcagggaaagagatctcttagatgtaccggtgttgctttatctatagctattggtttgttggagagcacttatcccaatacaggagctagagttatgctttttgttggaggaccgtgctctcaagggcctggtcaggttttgaatgatgatttaaaacaacctattagatctcatcatgatattcaaaaagataatgcaaagtatatgaaaaaaggtataaagcattatgatgctttggctatgagagcagcaactaatgggcattgtgttgatatttattcttgtgctttggatcagactggtttgatggagatgaaacagtgctgcaattctacaggcggtcacatggtaatgggagattcattcaattcctccctattcaaacagacattccaacgggtgttcaccaaagatcaaaagggcgaattaaaaatggctttcaacgggactctggaagtgaaatgttctagagaattgaaagtgcaaggagggattggttcttgcgtatcattgaatgtaaaaggtccgcttgtttcggataccgaaatcggtatgggaaatacggtgcaatggaaaatgtgcactttaactccaagtaccactatagcgctgtttttcgaagtggtcaatcagcattctgcaccgattcctcaaggaggaagaggatgcatacaatttattactcaatatcagcattctaatggtcagagaaggatcagagtgagtaccatagctcgtaattgggcggacgcgaccgcgaatattcatcacattagcgctgggttcgatcaagaagcggccgctgtaattatggccaggatggctgtatacagagcggaatcggacgatagtcctgatgttcttagatgggtggacaggatgttgattagattgtgtcaaaaattcggagaatacaacaaggacgacgcgaattcgttcagattgggtcaaaactttagcctctatccccaattcatgtaccatctgagacgttctcaattcctgcaagttttcaataattcaccggacgaaacgtcgtattatcggcacatgttaatgagagaagatctgacgcagtctttgattatgatccagccgattttgtacagttacagcttcaacgggcccccggaacccgttctgttggatacgagttcgattcaatcggagaggatattattgatggacactttcttccaaatattgatattccacggagagacaatagctcagtggcgtaacttgaaataccaagatatgccggaatacgaaaactttagacaactgttacaagcacccgtggacgatgctcaggaaatattgcagacgagatttcccatgccgagatacatcgataccgaacagggcggttctcaagctagatttttactatccaaagtcaatccgagtcaaactcataacaatatgtacgcatatggaggcgacgctggtgcgcccgttttgaccgacgatgtatcccttcaagtgttcatggatcatctaaaaaaattggcggtttcatctacagcttag

SEQ ID NO: 831 - DNA, 2328 bp, Psylliodes chrysocephala; identical to SEQ ID NO: 830
  misc_feature: sec23A

SEQ ID NO: 832 - DNA, 2328 bp, Psylliodes chrysocephala; identical to SEQ ID NO: 830
  misc_feature: sec23A

SEQ ID NO: 833 - DNA, 2328 bp, Psylliodes chrysocephala; identical to SEQ ID NO: 830
  misc_feature: sec23A

SEQ ID NO: 834 - DNA, 2328 bp, Psylliodes chrysocephala; identical to SEQ ID NO: 830
  misc_feature: sec23A

SEQ ID NO: 835 - DNA, 2328 bp, Psylliodes chrysocephala; identical to SEQ ID NO: 830
  misc_feature: sec23A

SEQ ID NO: 836 - DNA, 2328 bp, Psylliodes chrysocephala; identical to SEQ ID NO: 830
  misc_feature: sec23A

SEQ ID NO: 837 - DNA, 2328 bp, Psylliodes chrysocephala; identical to SEQ ID NO: 830
  misc_feature: sec23A

SEQ ID NO: 838 - DNA, 2328 bp, Psylliodes chrysocephala; identical to SEQ ID NO: 830
  misc_feature: sec23A

SEQ ID NO: 839 - DNA, 2328 bp, Psylliodes chrysocephala; identical to SEQ ID NO: 830
  misc_feature: sec23A

SEQ ID NO: 840 - DNA, 2328 bp, Psylliodes chrysocephala; identical to SEQ ID NO: 830
  misc_feature: sec23A

SEQ ID NO: 841 - DNA, 792 bp, Psylliodes chrysocephala
  misc_feature: Rps4
ctcaagatggctcgaggacctaaaaagcatttgaaacgtttaaatgcgccgaaagcatggatgttggacaaattgggaggtgtatttgctccacgtccatccaccggccctcacaaactaagggaatcattgcctttggtaattttcttgagaaataggctgaagtatgcccttacaaacagcgaagtaacaaaaattgttatgcaaagattgataaaagtcgatggaaaagttagaaccgatgccaattatccagctggatttatggatgttatcaccattgaaaaaactggagaatttttccgtcttatttatgatgtaaaaggaaggtttgccattcaccgtataacagctgaagaagctaaatacaaactttgcaaaattaggagagtccagactggaccaaaaaatataccattcattgtaacacatgatggacatacacttcgttatcccgaccccaacatcaaagtaaatgacaccattcaattggaaattgccacatctaaaatcctggactacattaagtttgaatctggtaacttgtgtatgattactggaggtagaaatttgggtcgtgttggtacggtaatcaatagggaacgtcatccaggatcctttgatattgtacacattaaggatgctaatggccacgtgtttgctactaggttacataatgtattcataattggtaagggagccaaagcttttgtatctcttccaagaggaaagggagttaagttgtccatagctgaagaaagagataagaggctagcagcaaaaacccactaa

SEQ ID NO: 842 - DNA, 792 bp, Psylliodes chrysocephala; identical to SEQ ID NO: 841
  misc_feature: Rps4

SEQ ID NO: 843 - DNA, 792 bp, Psylliodes chrysocephala; identical to SEQ ID NO: 841
  misc_feature: Rps4

SEQ ID NO: 844 - DNA, 792 bp, Psylliodes chrysocephala; identical to SEQ ID NO: 841
  misc_feature: Rps4

SEQ ID NO: 845 - DNA, 792 bp, Psylliodes chrysocephala; identical to SEQ ID NO: 841
  misc_feature: Rps4

SEQ ID NO: 846 - DNA, 792 bp, Psylliodes chrysocephala; identical to SEQ ID NO: 841
  misc_feature: Rps4

SEQ ID NO: 847 - DNA, 792 bp, Psylliodes chrysocephala; identical to SEQ ID NO: 841
  misc_feature: Rps4

SEQ ID NO: 848 - DNA, 792 bp, Psylliodes chrysocephala; identical to SEQ ID NO: 841
  misc_feature: Rps4

SEQ ID NO: 849 - DNA, 792 bp, Psylliodes chrysocephala; identical to SEQ ID NO: 841
  misc_feature: Rps4

SEQ ID NO: 850 - DNA, 792 bp, Psylliodes chrysocephala; identical to SEQ ID NO: 841
  misc_feature: Rps4

SEQ ID NO: 851 - DNA, 846 bp, Psylliodes chrysocephala
  misc_feature: Proteasome beta 5
tcaaccatgagtttggaagaaatttgtggaattccacaatataactctctagattatgaaagattaatgcacgatgatggcttgtccagatattgcaggaacttcgataatggcatggacttagcagtgcccccttttctaaatcaaagcaataattttgccaaatttacaaaggacgacagtggacgtgaaatcaaaattaattttgaccatggtacaactactctggggttcatgtacaaagggggtgtagtactcgctgtagactctagggcaacaggaggtcaattcattgggtcgcaaactatgaagaaaattgtagaaattaatgattttctgttgggtactttggctggaggagcagcagattgtgtatactgggatcgagttttagctaagcaatgtagaatgtatgaactcagaaatagggaaagaatttctgttgcagctgcttctaagttgatggccaacatggtttacaattacaagggaatggggttatctatgggaatgatgttggctggttgggacaagaggggtcctcaactttactatgtcgattctgaagggcttagaacacctggaaaagtgttcagtgtaggttcaggttccatctatgcttttggtgtgctcgattcaggttacaaatgggatttgacagacgaagaagcatatgatttaggtcgcaggtctatctatcatgctacccatagagatgcttattcaggaggtattgtaagagtataccacatgaaggagactggctgggaacttattgataataatgattgtaacgatttgcactataagtaccaagaggagaagtctaaagagggtggtgcttaa

SEQ ID NO: 852 - DNA, 846 bp, Psylliodes chrysocephala; identical to SEQ ID NO: 851
  misc_feature: Proteasome beta 5

SEQ ID NO: 853 - DNA, 846 bp, Psylliodes chrysocephala; identical to SEQ ID NO: 851
  misc_feature: Proteasome beta 5

SEQ ID NO: 854 - DNA, 846 bp, Psylliodes chrysocephala; identical to SEQ ID NO: 851
  misc_feature: Proteasome beta 5

SEQ ID NO: 855 - DNA, 846 bp, Psylliodes chrysocephala; identical to SEQ ID NO: 851
  misc_feature: Proteasome beta 5

SEQ ID NO: 856 - DNA, 846 bp, Psylliodes chrysocephala; identical to SEQ ID NO: 851
  misc_feature: Proteasome beta 5

SEQ ID NO: 857 - DNA, 846 bp, Psylliodes chrysocephala; identical to SEQ ID NO: 851
  misc_feature: Proteasome beta 5

SEQ ID NO: 858 - DNA, 846 bp, Psylliodes chrysocephala; identical to SEQ ID NO: 851
  misc_feature: Proteasome beta 5

SEQ ID NO: 859 - DNA, 846 bp, Psylliodes chrysocephala; identical to SEQ ID NO: 851
  misc_feature: Proteasome beta 5

SEQ ID NO: 860 - RNA, 247 nt, artificial sequence
  synthetic construct
gucccaucccggaauagaccauuccgaugugcuucgugaucauuuccacuuuguggacgcuguguucgucguaaagaauggauuugugcuuguuuuccguggcuauuaccacuccauuugaugcuuuuauuccuacugacggagcaccagccgcuacugccgcuaaagcauauucgauuuggacuaguuuaccugaagggcugaaaguuguuaaagaaaaacuauaacguucagaugacauuuucac

SEQ ID NO: 861 - RNA, 254 nt, artificial sequence
  synthetic construct
gaauuggccgccaguggcucgggaauccacugcgagcacuacgcccccuuuguacaugaaucccaauguggugguaccguggucgaacuugauuuugaucucacggccguuaucaucuuuggugaaccuugcaaaguuguugcugggaucaggaaaagggggaacagcuaaguucaugccauucuugaaauuggugcaauacuucugcaggcucucgucguaggcgagucgcucguaauccucggaauuguagc

SEQ ID NO: 862 - RNA, 255 nt, artificial sequence
  synthetic construct
guuucaccuucauucucuuggcguucgccuggucggccaacaucuuggcgcgcgccuucucggccuucuucuuguggauguauuccaucaggacgcgcuuguucuugaacacguuacccuucgccuucauguacagcgaaugguacagaugccugucgauuuucuuggccucgcgguacuucuucaacaaacgacggagcacccucauacguugaauccauaauucuuuucuugguguucgagcguucgcuguac

SEQ ID NO: 863 - RNA, 254 nt, artificial sequence
  synthetic construct
gauuuucucaguguaaugacgcgcuucuuagguccaauacaacaacccuuaaucaugacgaagucguuguuaacuucaccguaaugagggaaaccacccaucgguguaauaguuuucucacuaagaucguaaucgguagcagcauuguuuuugaugaccuuuccguccuuagugugaauuccagcgccgauucuguagauuuucuuguucaucuccguccugugaugguaacccuuuugaccagcacgagcgac

SEQ ID NO: 864 - RNA, 260 nt, artificial sequence
  synthetic construct
gccuuaacauuuucgauaguaucagaugguucaacuucaagaguaauuguuuuaccaguaagaguuuuaacgaauauuugcauuccuccacguagacgaagaacuaaaugcaguguggacucuuuuugaauauuguagucagacaauguucugccaucuuccaguuguuuaccggcgaagauuaaacguugcugaucuggaggaauccccucuuugucuuggauuuucgccuuaacguucucaauaguaucagaugguuc

SEQ ID NO: 865 - RNA, 247 nt, artificial sequence
  synthetic construct
gaaguuuuuggcuaagauuccaucuuucuucguuaaccucacaauacaaucguccgauucucccauacgccugauagcuccgcagagggcguagcuuuuggaacuuucggucauccuuccgguuaaaggaucgacaucggcuacgcugaguugaaugcuagcgugguccuuagcaugaauaauucuguugcuagcagagcauuuccuugggcaguacaagucgacgguuucaccagcgucguuuucc

SEQ ID NO: 866 - RNA, 258 nt, artificial sequence
  synthetic construct
guguguuuuugcagcuagccuuuuaucccuuucuucggcuauggacaacuuaacacccuuaccucuuggaagagauacaaaggcuuuagcuccuuuaccaaucacgaauacauuauuuaaucuaguugcaaaagcaugaccauuggcguccuuaauguguacaauaucgaaggaaccgggaugacgcucccuguucauaauuguaccaacacgucccaaauuucuaccuccgguaaucaugcacaaguuguuugauuc

SEQ ID NO: 867 - RNA, 265 nt, artificial sequence
  synthetic construct
guuaucauuaagcguaaucacuuucagcuguugccucaugguccuggcaggauuuugcaggauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuucucuucgguuuucuucuccuucuccuccuucucgggcuucuuaucgucuuuaucuucguccacauccauuuuc

SEQ ID NO: 868 - RNA, 272 nt, artificial sequence
  synthetic construct
gcacccuucucucucuuaacgcguacauaccagccucggugcaaacacccuucacuucggcaccgcuagcgcccggcaucaauucggcgauuuuccucagauugauuccucuggucaaauucauuuuucuagagugaauuuucaggauguccaaucgggcuuccucguucgguggcgggaauucgauuuuccugucgauucugccgggucugagcaaagccgggucuaaaauaucgauucuguugguggccaugaugacuuuaauguuuuuc

SEQ ID NO: 869 - RNA, 258 nt, artificial sequence
  synthetic construct
gcuccggagggccguugaaacuguaacuguacaaaauugguugaaucaugaucaaugauugaguaagaucuucucucaucagcauaugucgauagaacgacguuucaucaggagaauuauugaaaacuugcaggaacugagaccuccuuagaugguacaugaauugcggauagaggcuaaaguuuuggcccaaucugaaugaaccagcaucgucuuuauuguauucuccgaauuuuugacacaaucgaaucagcauuc

SEQ ID NO: 870 - RNA, 252 nt, artificial sequence
  synthetic construct
gaucuggauggcccaacaugucuuuugauuuauacguuuucaaggcccaagaaaguauuguaacguauucguuaccuuugagcccguuuuguauaauuucuuguagauguacagaaagaccaccaugauacauaugaauguauuugucuaauauuuuguaacuugguggaaaacaaggaagacagaguguuuuaacaauucucaaaucuucuaagaucaucauucuaauuaguucuaaauaacguauaagcc

SEQ ID NO: 871 - RNA, 251 nt, artificial sequence
  synthetic construct
guuccaucuauuuguaguugcguuuuuuccaaucguuucuucuuuuugagcgcuugaagcgccacucuuuuguucuucgaugcauucuuuuuggcuacuaaaguguauuccucuauuuucuuuucuaaaaacucuuguuuuuuauauaacauguccucgguuucccugagcuuuuggauggccuccccgggcguagggcccucgucuuuuuccuuuccuccgaauauuuuacuaaagaaacucauuuuucc

SEQ ID NO: 872 - RNA, 254 nt, artificial sequence
  synthetic construct
gccgacgacaaaagggcgucuuucgcgugguuuuucuuaacauccagcgagucuuugaugaaaaguucggcuugagcgcaaaaaucgucuucuugaauguaaauuucgcuuagagccugcgcguugugcucuuuacaguauuuuaugaacagcgauugagcgauagggaaauuucugauggucaucuuaaaguccccuaaaggcauguuuucucucaauuucaauaugacaguauaaacuaaauccguaucgcc

SEQ ID NO: 873 - RNA, 238 nt, artificial sequence
  synthetic construct
gggggggaucgauuugcuggcguugaagaacaaagugaagaucaacaacacgcuggaggcgcgauuggacuugaucucgcagcaauuggugccucaaauccguaacgcucuguucgggcguaacgugaacaggaaauucaccgauuagguugcuugggguuugugcgaucguauaauauuuacaucggucgaaauaaaauaguauucgauuuauaaaauuuauuguaauguuaucauc

SEQ ID NO: 874 - RNA, 267 nt, artificial sequence
  synthetic construct
guacaucccaaucauguucuucaacauacccacgguuuuguagaagggacagaaucugucguacgaugaguacgaguucuguugcaggaaaucuucuuucaacagcuuggcgauuuccaauguaauuuuaucagcuucggccaaugaagcuuuuccuaccagcugcacgauuucuguaagaucgucuucuucuugaagaauuuccuuaacuuugguucugagcgguaugaauuccgcaaaguuuuugucauagaaaucaucuaaggc

SEQ ID NO: 875 - RNA, 257 nt, artificial sequence
  synthetic construct
guuuucaccauaucucaacgccaauuuggucaaaguagaggccaaagaagcugcaaugaaaaaaucuccauccaugagauauugccucaauggaggucucuucucuuuuguagauuugcuggccacguugaaagcagauugaguggcguaaguuccauccgaaguaaccaaagugguggccccggcuggugcaugagcuggcgcacuaucaucuguacuacccgauauaaucuuuugcucagacuccaacagagggc

SEQ ID NO: 876 - RNA, 240 nt, artificial sequence
  synthetic construct
gucgucaucuauauugauauccguuguaucuauauuuucaucaauguucacuccaucaagauccaaauccaaaucguccucaucagcuucuucauuaucaacagaggguuuguucguuuguucaaccgguguuucgccgagcaaauuaucgaaauaacuugcaccugaauuuuugacuuucgcuugaaccuccgcuaucauauuucugucgugauucgguguaacggugacagccgaagc

SEQ ID NO: 877 - RNA, 269 nt, artificial sequence
  synthetic construct
gccaaggcggugauuuccuuuugcauacggucagcaauaccaggguacauggugguaccaccggacaagacgguguuggcguacaaguccuuacggauaucgacgucacacuucaugauggaguuguagacgguuucguggauaccgcaggauuccauacccaagaaggaagguuggaauagagccucaggacaacggaaucucucguuaccgauggugaugacuugaccgucggguaauucguagcucuuuuccaaugagguggaagc

SEQ ID NO: 878 - RNA, 351 nt, artificial sequence
  synthetic construct
guaagguuuuccucaagguuuccauuugcaaaccgcaaauauauucgcuggcuauucucaguaauugcugagccucggaaauuucuuguuuguuguccaccacaagcaauguaacggacaacagcagaguuuguaauuucucgauggcuucagugaauuuaccaccaguggucaguugauagcaaaucugcaauuuagcgaccaaaucguucaauuucaccccagaagcggguaacugguuuuuaauauuggcuuccuuccaguuucucaacggguaacuaaacgaaggcgguacguuuuguugccaagacgacaccgucuucgaaguacuguacaaauugaugaacaagc

SEQ ID NO: 879 - RNA, 352 nt, artificial sequence
  synthetic construct
guucuaauuugaauaucaccaugccgccaucguggccagcagcgaauaaauuaagauucggguggcucgucaucacccaaaaucguucguguucccuucuaaaaguaugcaagcaaguccuuuuagccauaucccaaacccuuauacuucuaucuucaccguuagacagaaucagcuccugucuaggaugaaacaaaacgcaagacacguuguuguaauguccucuacaaguaucuacuucccaagcuuucgaaucguucauucuccacagcuuuauuugccugucaucggcuccggaagcuauuaaagguaggaaaggaugaaaagaugcccaauucacuccucgaucguc

SEQ ID NO: 880 - RNA, 351 nt, artificial sequence
  synthetic construct
gagugguaaaaucgaguuuucuuaaauacuucucuuugacguaauacaguagguucccguguaccguguaagcuggucguucgcguucuaauuugaauaucaccaugccgccaucguggccagcagcgaauaaauuaagauucggguggcucgucaucacccaaaaucguucguguucccuucuaaaaguaugcaagcaaguccuuuuagccauaucccaaacccuuauacuucuaucuucaccguuagacagaaucagcuccugucuaggaugaaacaaaacgcaagacacguuguuguaauguccucuacaaguaucuacuucccaagcuuucgaaucguucauucucc

SEQ ID NO: 881 - RNA, 350 nt, artificial sequence
  synthetic construct
gauauaauacuuuggccuaccaaucgagaauuccugaccauguacaaaaccucuucguacuugugauugaucaaugcgaguuugaauuuguauucagugggaucgauuaccaacaggcgaggcuuacauucccuguccaaacagaacaccugacuaccucugacucuaguuauguaaaugggaagauccaggguucuaauaauuccgugaucaccauuuuucaacguguauuuaauaugauuacuaguaguguaaaugaaaacgccgcuaucaucccaagcgcccgacuuaacucugguauucucguguaacgaacacagaacauccaauuuucuauuacaaaucgucac

SEQ ID NO: 882 - RNA, 352 nt, artificial sequence
  synthetic construct
guaccuaaacugaugcgugcuaauccucaauccaaucguauccuuuccaacuuccgccacuuugcaaauauuacacaauaccccuuuguauuuagguaaauaugaaguaccgcauaauggacauuucucuucggccuuuccccuguaaauggguguauaagagugcccacacaaguugaaaggauugugcucgucauacugcaauugcaaaucaucuguaagauuagaaucgcaagccuguaauauuuuucuagcuugcugggcuacuucaggccuaggaccaaguuccaacagccucuuggcgaaagaagcggcuguuuuguaguucuugagcuugaaaaacauguugagc

SEQ ID NO: 883 - RNA, 352 nt, artificial sequence
  synthetic construct
guuacaaugcgugaaauaggcagccaucucgcacugacguuucugcucuucggcugaaguuuucgguaagguuuuccucaagguuuccauuugcaaaccgcaaauauauucgcuggcuauucucaguaauugcugagccucggaaauuucuuguuuguuguccaccacaagcaauguaacggacaacagcagaguuuguaauuucucgauggcuucagugaauuuaccaccaguggucaguugauagcaaaucugcaauuuagcgaccaaaucguucaauuucaccccagaagcggguaacugguuuuuaauauuggcuuccuuccaguuucucaacggguaacuaaacgac

SEQ ID NO: 884 - RNA, 352 nt, artificial sequence
  synthetic construct
guaguguaaaugaaaacgccgcuaucaucccaagcgcccgacuuaacucugguauucucguguaacgaacacagaacauccaauuuucuauuacaaaucgucacguuaugcuuagauagaagagcuagaugcgacauaucagaagaccacacgacguaucuacauuugcugauuuuaacuugagccaauguccucuuuuguuggacaucaaacaacguaacguguucggaaucucucaauaaaagcaugccaguuccggcguaaaagacuucaucgcaagugggcguuugaacuuuuuuaguuaccucguuuuucagauuuuuaaugaucaacuggugcguccuguccaguc

SEQ ID NO: 885 - RNA, 351 nt, artificial sequence
  synthetic construct
guaugauuacuaguaguguaaaugaaaacgccgcuaucaucccaagcgcccgacuuaacucugguauucucguguaacgaacacagaacauccaauuuucuauuacaaaucgucacguuaugcuuagauagaagagcuagaugcgacauaucagaagaccacacgacguaucuacauuugcugauuuuaacuugagccaauguccucuuuuguuggacaucaaacaacguaacguguucggaaucucucaauaaaagcaugccaguuccggcguaaaagacuucaucgcaagugggcguuugaacuuuuuuaguuaccucguuuuucagauuuuuaaugaucaacuggugc

SEQ ID NO: 886 - RNA, 351 nt, artificial sequence
  synthetic construct
gaggauuuuugaggugaucuucgagccccgagggacccggugauacguucuucuuacguaguccagaaauaucccaaacucuaacaguagaauccaaugaagcggauaacaguagauccucgcuaggauggaaaguagcgcacaugacauagugauuguggccgguuaaaacgcaaaugcacguucuggauugccaguuccauauccggaugguuugaucaucggaugcggauacuauccagggauauucgugguggaacauagucgugcgaauguaauccaaaugcccaagcagugugaagaugcaacguuucuguuuguaguuccauacuuuuauuuuguaaucaucgc

SEQ ID NO: 887 - RNA, 351 nt, artificial sequence
  synthetic construct
gaaucgagaauuccugaccauguacaaaaccucuucguacuugugauugaucaaugcgaguuugaauuuguauucagugggaucgauuaccaacaggcgaggcuuacauucccuguccaaacagaacaccugacuaccucugacucuaguuauguaaaugggaagauccaggguucuaauaauuccgugaucaccauuuuucaacguguauuuaauaugauuacuaguaguguaaaugaaaacgccgcuaucaucccaagcgcccgacuuaacucugguauucucguguaacgaacacagaacauccaauuuucuauuacaaaucgucacguuaugcuuagauagaagagc

SEQ ID NO: 888 - RNA, 351 nt, artificial sequence
  synthetic construct
guaccuaaacugaugcgugcuaauccucaauccaaucguauccuuuccaacuuccgccacuuugcaaauauuacacaauaccccuuuguauuuagguaaauaugaaguaccgcauaauggacauuucucuucggccuuuccccuguaaauggguguauaagagugcccacacaaguugaaaggauugugcucgucauacugcaauugcaaaucaucuguaagauuagaaucgcaagccuguaauauuuuucuagcuugcugggcuacuucaggccuaggaccaaguuccaacagccucuuggcgaaagaagcggcuguuuuguaguucuugagcuugaaaaacauguugac

SEQ ID NO: 889 - RNA, 351 nt, artificial sequence
  synthetic construct
guauaggaacgaauucuucagccgguuccuccuuuuuguccucuuuuucgaucuuaucguccuguucauuuuuaccgucuugcucauucuucucaucuguuucauucugaucgucuuucucgucuuguuuguccucaucuuucuucucguuuacuucacucucaguagucuccauugguuccacugccucagccucgguuugauccuucucuuccuucucgcugggaauuucuucgucuuuauucucacucacguuaucagucucuuuggggucuucuuucgguuucucugaaucguuuuugacguuaucagcguuucucuuaucgucucugucguaauaaucucuucugc

SEQ ID NO: 890 - RNA, 351 nt, artificial sequence
  synthetic construct
guuuguccauucacggugaacuguagcguuauagaagagucguugauguccaaaaaugcaccgauuacgucuccaacgucgaauguuauuccguaaucagagaacuccuuauuuuuaacgauuuuuccugaagaaucguagccguaugauuuaucaucuucacccaauuguagugaaguccaagcggcugaccaacccaaucuaauaaagugaguggguauaggaacgaauucuucagccgguuccuccuuuuuguccucuuuuucgaucuuaucguccuguucauuuuuaccgucuugcucauucuucucaucuguuucauucugaucgucuuucucgucuuguuugucc

SEQ ID NO: 891 - RNA, 351 nt, artificial sequence
  synthetic construct
gaacgaauucuucagccgguuccuccuuuuuguccucuuuuucgaucuuaucguccuguucauuuuuaccgucuugcucauucuucucaucuguuucauucugaucgucuuucucgucuuguuuguccucaucuuucuucucguuuacuucacucucaguagucuccauugguuccacugccucagccucgguuugauccuucucuuccuucucgcugggaauuucuucgucuuuauucucacucacguuaucagucucuuuggggucuucuuucgguuucucugaaucguuuuugacguuaucagcguuucucuuaucgucucugucguaauaaucucuucugcuucguc

SEQ ID NO: 892 - RNA, 351 nt, artificial sequence
  synthetic construct
gaggaacgaauucuucagccgguuccuccuuuuuguccucuuuuucgaucuuaucguccuguucauuuuuaccgucuugcucauucuucucaucuguuucauucugaucgucuuucucgucuuguuuguccucaucuuucuucucguuuacuucacucucaguagucuccauugguuccacugccucagccucgguuugauccuucucuuccuucucgcugggaauuucuucgucuuuauucucacucacguuaucagucucuuuggggucuucuuucgguuucucugaaucguuuuugacguuaucagcguuucucuuaucgucucugucguaauaaucucuucugcuuc

SEQ ID NO: 893 - RNA, 351 nt, artificial sequence
  synthetic construct
gcggugaacuguagcguuauagaagagucguugauguccaaaaaugcaccgauuacgucuccaacgucgaauguuauuccguaaucagagaacuccuuauuuuuaacgauuuuuccugaagaaucguagccguaugauuuaucaucuucacccaauuguagugaaguccaagcggcugaccaacccaaucuaauaaagugaguggguauaggaacgaauucuucagccgguuccuccuuuuuguccucuuuuucgaucuuaucguccuguucauuuuuaccgucuugcucauucuucucaucuguuucauucugaucgucuuucucgucuuguuuguccucaucuuucuuc

SEQ ID NO: 894 - RNA, 351 nt, artificial sequence
  synthetic construct
guuucauucugaucgucuuucucgucuuguuuguccucaucuuucuucucguuuacuucacucucaguagucuccauugguuccacugccucagccucgguuugauccuucucuuccuucucgcugggaauuucuucgucuuuauucucacucacguuaucagucucuuuggggucuucuuucgguuucucugaaucguuuuugacguuaucagcguuucucuuaucgucucugucguaauaaucucuucugcuucgucuauccgaccuguaccgguuaucucgaugaucugguuguuguugccaaucgucccauuuuaauuucucaguuacuuucauuucguaauaaacc

SEQ ID NO: 895 - RNA, 351 nt, artificial sequence
  synthetic construct
gguguagguucuaguguugccacagguucguugguuguuucggauuuacccucgucggguuguugcuuuucuggagacggggcgcucuccuugacccucgcuucauccuuugcuuccguaagcaagguauuuuuuggcguuaggucuucuucgacuuccucugucgagguaucuaauauugauguaucagcuauuucuucaucuaauucguucucuaaagcuucuuuuaaacguuuaacgaguauagguuuggugccuuucacgucgagcccucgagccgaaaguucauuccguaaaucuacuaccuucaguuuagccggaucuaucuuggaacucaucguguaagauauc

SEQ ID NO: 896 - RNA, 351 nt, artificial sequence
  synthetic construct
gcguuauagaagagucguugauguccaaaaaugcaccgauuacgucuccaacgucgaauguuauuccguaaucagagaacuccuuauuuuuaacgauuuuuccugaagaaucguagccguaugauuuaucaucuucacccaauuguagugaaguccaagcggcugaccaacccaaucuaauaaagugaguggguauaggaacgaauucuucagccgguuccuccuuuuuguccucuuuuucgaucuuaucguccuguucauuuuuaccgucuugcucauucuucucaucuguuucauucugaucgucuuucucgucuuguuuguccucaucuuucuucucguuuacuucac

SEQ ID NO: 897 - RNA, 351 nt, artificial sequence
  synthetic construct
guuaacgauuuuuccugaagaaucguagccguaugauuuaucaucuucacccaauuguagugaaguccaagcggcugaccaacccaaucuaauaaagugaguggguauaggaacgaauucuucagccgguuccuccuuuuuguccucuuuuucgaucuuaucguccuguucauuuuuaccgucuugcucauucuucucaucuguuucauucugaucgucuuucucgucuuguuuguccucaucuuucuucucguuuacuucacucucaguagucuccauugguuccacugccucagccucgguuugauccuucucuuccuucucgcugggaauuucuucgucuuuauucuc

SEQ ID NO: 898 - RNA, 352 nt, artificial sequence
  synthetic construct
gucuaauaaagugaguggguauaggaacgaauucuucagccgguuccuccuuuuuguccucuuuuucgaucuuaucguccuguucauuuuuaccgucuugcucauucuucucaucuguuucauucugaucgucuuucucgucuuguuuguccucaucuuucuucucguuuacuucacucucaguagucuccauugguuccacugccucagccucgguuugauccuucucuuccuucucgcugggaauuucuucgucuuuauucucacucacguuaucagucucuuuggggucuucuuucgguuucucugaaucguuuuugacguuaucagcguuucucuuaucgucucuguc

SEQ ID NO: 899 - RNA, 350 nt, artificial sequence
  synthetic construct
gggauagaacgugcgggauuagcgucaaaucaucggguaaaucgucccuggguauuucaauagucgguugaauuuguccauucacggugaacuguagcguuauagaagagucguugauguccaaaaaugcaccgauuacgucuccaacgucgaauguuauuccguaaucagagaacuccuuauuuuuaacgauuuuuccugaagaaucguagccguaugauuuaucaucuucacccaauuguagugaaguccaagcggcugaccaacccaaucuaauaaagugaguggguauaggaacgaauucuucagccgguuccuccuuuuuguccucuuuuucgaucuuaucgucc

SEQ ID NO: 900 - RNA, 352 nt, artificial sequence
  synthetic construct
guagcaucuuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcaauuuaucaccuccaauugcaacauuaacccaagcuugcgcuagcuguguuaacguagcaucaucaucuuuauccugcauuuccuugagcuucuucuuagccaaaucuacccgaucuaacuucaauaauauaucgaugaugaaggcguaagcuuccagauuuuccgaagcgugaagcacuuuguaagcggcuuccaaguugc

SEQ ID NO: 901 - RNA, 352 nt, artificial sequence
  synthetic construct
guuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcaauuuaucaccuccaauugcaacauuaacccaagcuugcgcuagcuguguuaacguagcaucaucaucuuuauccugcauuuccuugagcuucuucuuagccaaaucuacccgaucuaacuucaauaauauaucgaugaugaaggcguaagcuuccagauuuuccgaagcgugaagcacuuuguaagcggcuuccaaguugccuucguc

SEQ ID NO: 902 - RNA, 351 nt, artificial sequence
  synthetic construct
gugcuucaaguccuuuauguaaggauggucgggauuggcgucuuucaauugcgauaaauaucuauuagcaaucucaggaccuuuccccauaugccuuugaagaguaauuaaauuaaccaauguaucaggauaauuagcaucuuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcaauuuaucaccuccaauugcaacauuaacccaagcuugcgcuagcuguguuaacguagcaucaucauc

SEQ ID NO: 903 - RNA, 351 nt, artificial sequence
  synthetic construct
guacgauggaaugguaauuacuguagguguauacuguugacauauucucuggaacucgcucucuuuaugcuucaaguccuuuauguaaggauggucgggauuggcgucuuucaauugcgauaaauaucuauuagcaaucucaggaccuuuccccauaugccuuugaagaguaauuaaauuaaccaauguaucaggauaauuagcaucuuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcac

SEQ ID NO: 904 - RNA, 352 nt, artificial sequence
  synthetic construct
guuaaauuaaccaauguaucaggauaauuagcaucuuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcaauuuaucaccuccaauugcaacauuaacccaagcuugcgcuagcuguguuaacguagcaucaucaucuuuauccugcauuuccuugagcuucuucuuagccaaaucuacccgaucuaacuucaauaauauaucgaugaugaaggcguaagcuuccagauuuuccgaagcgugac

SEQ ID NO: 905 - RNA, 352 nt, artificial sequence
  synthetic construct
guauucucuggaacucgcucucuuuaugcuucaaguccuuuauguaaggauggucgggauuggcgucuuucaauugcgauaaauaucuauuagcaaucucaggaccuuuccccauaugccuuugaagaguaauuaaauuaaccaauguaucaggauaauuagcaucuuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcaauuuaucaccuccaauugcaacauuaacccaagcuugcgcuac

SEQ ID NO: 906 - RNA, 351 nt, artificial sequence
  synthetic construct
gccuuuauguaaggauggucgggauuggcgucuuucaauugcgauaaauaucuauuagcaaucucaggaccuuuccccauaugccuuugaagaguaauuaaauuaaccaauguaucaggauaauuagcaucuuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcaauuuaucaccuccaauugcaacauuaacccaagcuugcgcuagcuguguuaacguagcaucaucaucuuuauccugc

SEQ ID NO: 907 - RNA, 352 nt, artificial sequence
  synthetic construct
guuacuguagguguauacuguugacauauucucuggaacucgcucucuuuaugcuucaaguccuuuauguaaggauggucgggauuggcgucuuucaauugcgauaaauaucuauuagcaaucucaggaccuuuccccauaugccuuugaagaguaauuaaauuaaccaauguaucaggauaauuagcaucuuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcaauuuaucaccuccaauuc

SEQ ID NO: 908 - RNA, 352 nt, artificial sequence
  synthetic construct
gcaaucucaggaccuuuccccauaugccuuugaagaguaauuaaauuaaccaauguaucaggauaauuagcaucuuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcaauuuaucaccuccaauugcaacauuaacccaagcuugcgcuagcuguguuaacguagcaucaucaucuuuauccugcauuuccuugagcuucuucuuagccaaaucuacccgaucuaacuucaauaauauaucgc

SEQ ID NO: 909 - RNA, 352 nt, artificial sequence
  synthetic construct
gacuagggugucguugcuggcguucgccauuacuugcuggucgauuugagacacuacggcauccuucuugacuuuaccggauagguacucagccaggaguuuuagugguuggauuucuggagaggaggccccguggauuucgucuaguacgacuaagaauuuguucugggccauguacgaucuguaggugaauacgucucgcuggauggcgacuucugggguugagggcuuucuuaguuuuugcccuucguuuaugcauuguugguaguuuccuauguaaaaguaguuuuuaauuucgaaaagcucgucuacgucuugcugcugacgugccauuuuuguuuugauuuuuuuc

SEQ ID NO: 910 - RNA, 352 nt, artificial sequence
  synthetic construct
guaaauaucuauuagcaaucucaggaccuuuccccauaugccuuugaagaguaauuaaauuaaccaauguaucaggauaauuagcaucuuuaucuauagcuuccugcaaagcagcuucagcuuccucguauuuagccugcccuauaaaggccacugcuugcccguuuaacagaagaggcgucgagccauauuuaucaaccauuucuugguaaauguaguaagcaucuugcaauuuaucaccuccaauugcaacauuaacccaagcuugcgcuagcuguguuaacguagcaucaucaucuuuauccugcauuuccuugagcuucuucuuagccaaaucuacccgaucuaacuc

SEQ ID NO: 911 - RNA, 351 nt, artificial sequence
  synthetic construct
guaaccuacagaagagguaauaagcucagcuaugcugucaucgggugaucuuacagucaauugcauuguaacaccauccgccaaagcaaguuuagcucuuaccaaaauaucgauuccuccucuaaagacuccugauaguagaagcgugugggugcucuugccuucgggcacuuuaucaguucuuucggccgguugcaauccaaggaacugcacgauauucuucacagcuucguccaacguauucaucgaacugagagaauacguauccuccuuuuccacggaacccucagcagccgauucccaagcggcgccccaauugccuuugcucacucucuguaucugaucgcccac

SEQ ID NO: 912 - RNA, 352 nt, artificial sequence
  synthetic construct
guuucagacacgaaacucgcuauuugcuucauuagacgaucgaccgaagauucagcaccuguuuucaacaaaguaguaauagcuaaaguggcaauggaucuguuagaaucgguaaucagauucuccaaauccaaauuacaagccguaacagcagcaggaugugaaaucgccacuugauucaauguucugacagcggcaaaucuuaaaguagccuucggugaaccgcagaauaauuguaaaacgcuuacggcaggcgcuaauucuuugcuaguagugcguuuuagauugacaauggcgugggcagcuucguaaacuaccauuucggauuugugucucagacaggacucgaugc

SEQ ID NO: 913 - RNA, 350 nt, artificial sequence
  synthetic construct
gacacgaaacucgcuauuugcuucauuagacgaucgaccgaagauucagcaccuguuuucaacaaaguaguaauagcuaaaguggcaauggaucuguuagaaucgguaaucagauucuccaaauccaaauuacaagccguaacagcagcaggaugugaaaucgccacuugauucaauguucugacagcggcaaaucuuaaaguagccuucggugaaccgcagaauaauuguaaaacgcuuacggcaggcgcuaauucuuugcuaguagugcguuuuagauugacaauggcgugggcagcuucguaaacuaccauuucggauuugugucucagacaggacucgaugaaauc

SEQ ID NO: 914 - RNA, 352 nt, artificial sequence
  synthetic construct
guucuaacagcuaaugaaacguguucgcaaucuucgauaaacucgcacagaugagccaaaccugacucuuuagcuucaggauuaucuucgauuaugguaauuauggugucugcaauggaagcuuuguacuccaaaccgccuucaucucuuagcauagccgauaaaaaguucaugagcguguuguguuuacgagggaauuuaagagccagugcucugaucgcuugaacuaccacaacuuugaauucaucgcuaauuucagacacgaaacucgcuauuugcuucauuagacgaucgaccgaagauucagcaccuguuuucaacaaaguaguaauagcuaaaguggcaauggauc

SEQ ID NO: 915 - RNA, 352 nt, artificial sequence
  synthetic construct
gcaauugcauuguaacaccauccgccaaagcaaguuuagcucuuaccaaaauaucgauuccuccucuaaagacuccugauaguagaagcgugugggugcucuugccuucgggcacuuuaucaguucuuucggccgguugcaauccaaggaacugcacgauauucuucacagcuucguccaacguauucaucgaacugagagaauacguauccuccuuuuccacggaacccucagcagccgauucccaagcggcgccccaauugccuuugcucacucucuguaucugaucgcccaacguuauuuccaagucuucgaguauguauucaucauuguaaccuucaucgcuaucggc

SEQ ID NO: 916 - RNA, 352 nt, artificial sequence
  synthetic construct
guacagaagagguaauaagcucagcuaugcugucaucgggugaucuuacagucaauugcauuguaacaccauccgccaaagcaaguuuagcucuuaccaaaauaucgauuccuccucuaaagacuccugauaguagaagcgugugggugcucuugccuucgggcacuuuaucaguucuuucggccgguugcaauccaaggaacugcacgauauucuucacagcuucguccaacguauucaucgaacugagagaauacguauccuccuuuuccacggaacccucagcagccgauucccaagcggcgccccaauugccuuugcucacucucuguaucugaucgcccaacguuac

SEQ ID NO: 917 - RNA, 352 nt, artificial sequence
  synthetic construct
guaaacucgcacagaugagccaaaccugacucuuuagcuucaggauuaucuucgauuaugguaauuauggugucugcaauggaagcuuuguacuccaaaccgccuucaucucuuagcauagccgauaaaaaguucaugagcguguuguguuuacgagggaauuuaagagccagugcucugaucgcuugaacuaccacaacuuugaauucaucgcuaauuucagacacgaaacucgcuauuugcuucauuagacgaucgaccgaagauucagcaccuguuuucaacaaaguaguaauagcuaaaguggcaauggaucuguuagaaucgguaaucagauucuccaaauccaaac

SEQ ID NO: 918 - RNA, 352 nt, artificial sequence
  synthetic construct
guucaucucuuagcauagccgauaaaaaguucaugagcguguuguguuuacgagggaauuuaagagccagugcucugaucgcuugaacuaccacaacuuugaauucaucgcuaauuucagacacgaaacucgcuauuugcuucauuagacgaucgaccgaagauucagcaccuguuuucaacaaaguaguaauagcuaaaguggcaauggaucuguuagaaucgguaaucagauucuccaaauccaaauuacaagccguaacagcagcaggaugugaaaucgccacuugauucaauguucugacagcggcaaaucuuaaaguagccuucggugaaccgcagaauaauuguac

SEQ ID NO: 919 - RNA, 351 nt, artificial sequence
  synthetic construct
guuaccaaaauaucgauuccuccucuaaagacuccugauaguagaagcgugugggugcucuugccuucgggcacuuuaucaguucuuucggccgguugcaauccaaggaacugcacgauauucuucacagcuucguccaacguauucaucgaacugagagaauacguauccuccuuuuccacggaacccucagcagccgauucccaagcggcgccccaauugccuuugcucacucucuguaucugaucgcccaacguuauuuccaagucuucgaguauguauucaucauuguaaccuucaucgcuaucgggaaugccgguggugggaucgcaaucuuuaacgauaaacuuc

SEQ ID NO: 920 - RNA, 351 nt, artificial sequence
  synthetic construct
guaacgaaucuaaaacuacccucuucuccauauucuuccuuagaauuuggcucacggaaucguauaagcaauuuaaaacgcucauuagaauuaacucauuuucaugagaacuacccaugacguagaaaaacaaaucuacguuacucuuguacacgcacguaaggccaucgagcauuauaauuucggcguucgcccuguggguuuuguugaacagauucuucucgaaagucuucugcucuuucgcugugggaaauacguuuuugucguaguacuuugccaauauucgguuuccaucguuauccaagauagcuaugccuuuaauggcguucaaaguggguuccaauaacgagc

SEQ ID NO: 921 - RNA, 351 nt, artificial sequence
  synthetic construct
guacuuuaauaaugaccauuucagcuguucuuuggcugauugaaacaccugggcgacuguuugcuccccaaucggaaugucgucguuucuuaaagccacccucgauaccaccgaguucgaaucggcaucgaugauaaucccuccaucgcagauuucauccauggccaacaugacuauaucuaacgaaucuaaaacuacccucuucuccauauucuuccuuagaauuuggcucacggaaucguauaagcaauuuaaaacgcucauuagaauuaacucauuuucaugagaacuacccaugacguagaaaaacaaaucuacguuacucuuguacacgcacguaaggccaucgac

SEQ ID NO: 922 - RNA, 351 nt, artificial sequence
  synthetic construct
guaucuaacgaaucuaaaacuacccucuucuccauauucuuccuuagaauuuggcucacggaaucguauaagcaauuuaaaacgcucauuagaauuaacucauuuucaugagaacuacccaugacguagaaaaacaaaucuacguuacucuuguacacgcacguaaggccaucgagcauuauaauuucggcguucgcccuguggguuuuguugaacagauucuucucgaaagucuucugcucuuucgcugugggaaauacguuuuugucguaguacuuugccaauauucgguuuccaucguuauccaagauagcuaugccuuuaauggcguucaaaguggguuccaauaac

SEQ ID NO: 923 - RNA, 352 nt, artificial sequence
  synthetic construct
gacccucuucuccauauucuuccuuagaauuuggcucacggaaucguauaagcaauuuaaaacgcucauuagaauuaacucauuuucaugagaacuacccaugacguagaaaaacaaaucuacguuacucuuguacacgcacguaaggccaucgagcauuauaauuucggcguucgcccuguggguuuuguugaacagauucuucucgaaagucuucugcucuuucgcugugggaaauacguuuuugucguaguacuuugccaauauucgguuuccaucguuauccaagauagcuaugccuuuaauggcguucaaaguggguuccaauaacgagccuuccauuagugaauuc

SEQ ID NO: 924 - RNA, 351 nt, artificial sequence
  synthetic construct
gagcuguucuuuggcugauugaaacaccugggcgacuguuugcuccccaaucggaaugucgucguuucuuaaagccacccucgauaccaccgaguucgaaucggcaucgaugauaaucccuccaucgcagauuucauccauggccaacaugacuauaucuaacgaaucuaaaacuacccucuucuccauauucuuccuuagaauuuggcucacggaaucguauaagcaauuuaaaacgcucauuagaauuaacucauuuucaugagaacuacccaugacguagaaaaacaaaucuacguuacucuuguacacgcacguaaggccaucgagcauuauaauuucggcguucgc

SEQ ID NO: 925 - RNA, 352 nt, artificial sequence
  synthetic construct
guucgucucuucuaaaacgcccaguaggucuaauaguauuuuguacgauuuuuugcugucuuucugguuguuggaaauuaaaucguuggugagagggauuauuucguaccgaaauccaauaauguggaucaaaauuaggaaauauuuguaugucaauaaagaguuguuuccguaugaaacaacacacgcgugaaacaucaguuuaaaauaauguucagaggauuuuuuguucgauucgauaagguuuugaagaugcuucaguaaaauaucgaacccaaaguacuccccaucgucugguuugaaaauuucguugacaaaaugcucgaacuucuucugguuguuaugaaauaac

SEQ ID NO: 926 - RNA, 351 nt, artificial sequence
  synthetic construct
guaacucucucauacugcgccagaauaucagcaacuaaauacauagcgauucuggccauauccuucugaugcuccaccaaacucuucguuaauuucuccaacugguaagcacaaucggacaaaucgcugauaaaaugcucguuucguucuuuguuggaaucccccuucagacacaacacucucaacaaggcccuguauuguugcaaauaaggcggcaaucuauccaugacuaaagcuuuucugaauuugagcaaauucgacagcaaagaaaccagcaaauuguaaaaagaaacgaacgaaagaggcuccuuuuccagcaaaguaguuacgcuuaguaucagcaaauccauc

SEQ ID NO: 927 - RNA, 351 nt, artificial sequence
  synthetic construct
gauuuuuaaaaaggaccucauuaagcugcaauuauggguuuuguuuaguagcgauuuuccgaacguuuucaaaauaucuugcaauuccuggaggcauuuuuuaguuuuuucuacuacauucgaagccacugugugcucugcuacucuuaugcuggacaaaaaugugcaaaucaacucgcugagaagcuccauauguaugcaauacacauccucacuaguuuccuucucuagcugcuugaucaaagcauucaauaacguuuugaauacguuuaucaccugccaacuggcuaaaguuuguauauuuuucguaaacgauaccaaaaucuucuuaguaaaaauauucucaacagc

SEQ ID NO: 928 - RNA, 352 nt, artificial sequence
  synthetic construct
guaauucuaaauguacaagcgaauugcucagcaaacuuuccacuccucguugcaaacgauugguuuucacaggguugauauuagcagugauaauggacucccacguuuucaggaagcuuacauaauuuuuauaauuauucucuuuaagugccugauuagacagaauugcuagaucuacaauaaugcaauugaauuguucguuggacaucaaacaaaccaucaggaacaccaauugcgaauacuccucaauucuaguaaaaacuuuaucguuguuuuugcauaaauuccaaauuuuuauguacagcucaucgucgaauuccuugauuuuaguuuuguuguuuaacacuguauc

SEQ ID NO: 929 - RNA, 352 nt, artificial sequence
  synthetic construct
guaacacuguauugaacagcaauaaguacccgguuuugucgaaaucguccuucuucuccaaggcgaaauuaacauaagaauucaauacaucuagcaucuucgaaagcuucucgucuucguuuugcacgaauaauauuuucaaggcguacgcauauccgcauacuaaaugauuauuagguucacucguuaauacuaaaucgcaaauuccauugcaaaucgacgauuuguaguuuuccguaugguuuuugauuucuuuggggaccuucauuuuuuuuaacuuguuaacggcauuuauaauuauaauuccgcauugcaaguagacaggauuucgcaaguuauuuguaaugugcuc

SEQ ID NO: 930 - RNA, 351 nt, artificial sequence
  synthetic construct
guaagcuuuaccagugaaccuguaguauuucuuauaauucucauacauuacuuugaaaauuucuguggaagcgcuggacaaaacccucauuaaacacgaaacagcgugcugaucacagaugguuaucaaacuauaaaugcaguuguucagaugcauuuugauauugggauaaaucguaacucucucauacugcgccagaauaucagcaacuaaauacauagcgauucuggccauauccuucugaugcuccaccaaacucuucguuaauuucuccaacugguaagcacaaucggacaaaucgcugauaaaaugcucguuucguucuuuguuggaaucccccuucagacacac

SEQ ID NO: 931 - RNA, 351 nt, artificial sequence
  synthetic construct
gugcaggauguuuucgaauaacuccugaucauauugggauaauucuaaauguacaagcgaauugcucagcaaacuuuccacuccucguugcaaacgauugguuuucacaggguugauauuagcagugauaauggacucccacguuuucaggaagcuuacauaauuuuuauaauuauucucuuuaagugccugauuagacagaauugcuagaucuacaauaaugcaauugaauuguucguuggacaucaaacaaaccaucaggaacaccaauugcgaauacuccucaauucuaguaaaaacuuuaucguuguuuuugcauaaauuccaaauuuuuauguacagcucaucguc

SEQ ID NO: 932 - RNA, 351 nt, artificial sequence
  synthetic construct
gcgaacuuucuguguguacaauuuguacaauaauugcuugcaagguacuucuccgaaguuguugauucucucugaaaucgaacaccaaucuucguguguuaaauauggauguaaauaaguaauguugcuagccauacaauuguauucuaaagcuuucuucuguguagaauccugagggcucgaguaauauuucaguaugauccccauuucagcccaauggaaggcuauuuuuaaaaaggaccucauuaagcugcaauuauggguuuuguuuaguagcgauuuuccgaacguuuucaaaauaucuugcaauuccuggaggcauuuuuuaguuuuuucuacuacauucgaagc

SEQ ID NO: 933 - RNA, 351 nt, artificial sequence
  synthetic construct
gacacgauuuucucagcuaaaauaauccuacuuuccggaucuaaaguaugcauuaaauuguuaguuaagaauuuauccugcaggauauccuuccaauuauucuccaaaucugaugucagauaccucgauaaauccacuaacacuucguugguaaguuuuuguucgaauaugcacaaugcacgaacuuucuguguguacaauuuguacaauaauugcuugcaagguacuucuccgaaguuguugauucucucugaaaucgaacaccaaucuucguguguuaaauauggauguaaauaaguaauguugcuagccauacaauuguauucuaaagcuuucuucuguguagaaucc

SEQ ID NO: 934 - RNA, 352 nt, artificial sequence
  synthetic construct
gacuuugugcuguacgaggugagucacuguggaacauucuucccuuuuaacuucagguugugaaguaacuuucucgaugauaccuucuacgauuuguuuuauacucugcguaucaauuucauuucuauugauuccuuuaaaauaggcagaagacaccaaauuuuccaguguuuuccauauuaaaucgaccucauuuuguuguaaaauccacuuuaagaggauaauuuuacauguuacaggcaauucgguagacuugaaaaaauugucuacauacugcaauuuaguugugaacguuucuuccucguuguuuaagugaauuaauaauucuuccucuagagucauuuuagauauc

SEQ ID NO: 935 - RNA, 351 nt, artificial sequence
  synthetic construct
gcgaauugcucagcaaacuuuccacuccucguugcaaacgauugguuuucacaggguugauauuagcagugauaauggacucccacguuuucaggaagcuuacauaauuuuuauaauuauucucuuuaagugccugauuagacagaauugcuagaucuacaauaaugcaauugaauuguucguuggacaucaaacaaaccaucaggaacaccaauugcgaauacuccucaauucuaguaaaaacuuuaucguuguuuuugcauaaauuccaaauuuuuauguacagcucaucgucgaauuccuugauuuuaguuuuguuguuuaacacuguauugaacagcaauaaguacc

SEQ ID NO: 936 - RNA, 351 nt, artificial sequence
  synthetic construct
gccaaaguucuccaguacuucuccgaaucuaugcaaauuccccauccuaaccgccuggguuaacuggaaguaaggggccaacgagugccucaugcuggccugccugaagaucugccuuucugguauaucccccaacagcaacucgacuacaacgguaagcuuuugcacuguuugucggaagcccaucgcagcauucuggggcgauuuccucauagcuugaauuagguguuuaugcgcaacgcuguacuccaaucgugcagcuuuaauucgaccuaaauaguacaaaaaccuggcccauucguuguugcuagccguuucgggauagacgcauuuauucacuaacuuaucagc

SEQ ID NO: 937 - RNA, 351 nt, artificial sequence
  synthetic construct
guuucacacucugauuaugcaggucuaaacaaaacgauauccucugaugaaaagcgaguugcggcucuuuagugcaauaaauaucugugcuuuccuugcuucucauauaccccccuuguggauccaagauagccucgauuacaccaucccgaauagcuuuagcaacgauaaauucugcaucuucagcgcaauccaggccgaguuucuuagcuauaucuugcggggauauucucgaguaagacaacccgauagaucuaauggcuguuuuuauaacguugugacgcagccguaguauuaaaguaaaaguaugauccaaucuaaauugcggcccaaaguucuccaguacuucuc

SEQ ID NO: 938 - RNA, 352 nt, artificial sequence
  synthetic construct
guaaauucugcaucuucagcgcaauccaggccgaguuucuuagcuauaucuugcggggauauucucgaguaagacaacccgauagaucuaauggcuguuuuuauaacguugugacgcagccguaguauuaaaguaaaaguaugauccaaucuaaauugcggcccaaaguucuccaguacuucuccgaaucuaugcaaauuccccauccuaaccgccuggguuaacuggaaguaaggggccaacgagugccucaugcuggccugccugaagaucugccuuucugguauaucccccaacagcaacucgacuacaacgguaagcuuuugcacuguuugucggaagcccaucgcac

SEQ ID NO: 939 - RNA, 350 nt, artificial sequence
  synthetic construct
gauuaugcaggucuaaacaaaacgauauccucugaugaaaagcgaguugcggcucuuuagugcaauaaauaucugugcuuuccuugcuucucauauaccccccuuguggauccaagauagccucgauuacaccaucccgaauagcuuuagcaacgauaaauucugcaucuucagcgcaauccaggccgaguuucuuagcuauaucuugcggggauauucucgaguaagacaacccgauagaucuaauggcuguuuuuauaacguugugacgcagccguaguauuaaaguaaaaguaugauccaaucuaaauugcggcccaaaguucuccaguacuucuccgaaucuaugc

SEQ ID NO: 940 - RNA, 351 nt, artificial sequence
  synthetic construct
gaauucuuucccguacgccuucgggggauaucucauagcuuucacacucugauuaugcaggucuaaacaaaacgauauccucugaugaaaagcgaguugcggcucuuuagugcaauaaauaucugugcuuuccuugcuucucauauaccccccuuguggauccaagauagccucgauuacaccaucccgaauagcuuuagcaacgauaaauucugcaucuucagcgcaauccaggccgaguuucuuagcuauaucuugcggggauauucucgaguaagacaacccgauagaucuaauggcuguuuuuauaacguugugacgcagccguaguauuaaaguaaaaguaugauc

SEQ ID NO: 941 - RNA, 351 nt, artificial sequence
  synthetic construct
gccuggguuaacuggaaguaaggggccaacgagugccucaugcuggccugccugaagaucugccuuucugguauaucccccaacagcaacucgacuacaacgguaagcuuuugcacuguuugucggaagcccaucgcagcauucuggggcgauuuccucauagcuugaauuagguguuuaugcgcaacgcuguacuccaaucgugcagcuuuaauucgaccuaaauaguacaaaaaccuggcccauucguuguugcuagccguuucgggauagacgcauuuauucacuaacuuaucagcuugaucguagagcgaguagugcaaguaauuucuuagcagacaauuaaucagc

SEQ ID NO: 942 - RNA, 351 nt, artificial sequence
  synthetic construct
guaaggaaauccaucaucaucuuccucggccauuucuuucgcuagcuccaaaucuuguugcucccuuucucgccucuccucggcagacuccaauucuuucccguacgccuucgggggauaucucauagcuuucacacucugauuaugcaggucuaaacaaaacgauauccucugaugaaaagcgaguugcggcucuuuagugcaauaaauaucugugcuuuccuugcuucucauauaccccccuuguggauccaagauagccucgauuacaccaucccgaauagcuuuagcaacgauaaauucugcaucuucagcgcaauccaggccgaguuucuuagcuauaucuugcgc

SEQ ID NO: 943 - RNA, 352 nt, artificial sequence
  synthetic construct
gacgucccgcucggcgacgggguacauuugauugaugaggcuccugaggacgguuccguucaguuugcgucugguguucggcaagcagcgcagcacucucaauauaaaucgguuuucuuugcugcucacugccuucucgaucugccuggcauguucgcgaauuuccaagacgcuuuguaagucgaugucacgcuugcugucuccagcuucuaagccugccgggcugucugcguuuuucaucucgacgucgguuucuacgcccauuuuuauucgaauauuuggaaaacaagaauuaguugcugaaaaauuguuuuucgcuguguaacgaugacaauuggcguguugacauugc

SEQ ID NO: 944 - RNA, 351 nt, artificial sequence
  synthetic construct
gcccuuucucgccucuccucggcagacuccaauucuuucccguacgccuucgggggauaucucauagcuuucacacucugauuaugcaggucuaaacaaaacgauauccucugaugaaaagcgaguugcggcucuuuagugcaauaaauaucugugcuuuccuugcuucucauauaccccccuuguggauccaagauagccucgauuacaccaucccgaauagcuuuagcaacgauaaauucugcaucuucagcgcaauccaggccgaguuucuuagcuauaucuugcggggauauucucgaguaagacaacccgauagaucuaauggcuguuuuuauaacguugugacgc

SEQ ID NO: 945 - RNA, 352 nt, artificial sequence
  synthetic construct
gcccaaaguucuccaguacuucuccgaaucuaugcaaauuccccauccuaaccgccuggguuaacuggaaguaaggggccaacgagugccucaugcuggccugccugaagaucugccuuucugguauaucccccaacagcaacucgacuacaacgguaagcuuuugcacuguuugucggaagcccaucgcagcauucuggggcgauuuccucauagcuugaauuagguguuuaugcgcaacgcuguacuccaaucgugcagcuuuaauucgaccuaaauaguacaaaaaccuggcccauucguuguugcuagccguuucgggauagacgcauuuauucacuaacuuaucagc

SEQ ID NO: 946 - RNA, 352 nt, artificial sequence
  synthetic construct
gaaauccaucaucaucuuccucggccauuucuuucgcuagcuccaaaucuuguugcucccuuucucgccucuccucggcagacuccaauucuuucccguacgccuucgggggauaucucauagcuuucacacucugauuaugcaggucuaaacaaaacgauauccucugaugaaaagcgaguugcggcucuuuagugcaauaaauaucugugcuuuccuugcuucucauauaccccccuuguggauccaagauagccucgauuacaccaucccgaauagcuuuagcaacgauaaauucugcaucuucagcgcaauccaggccgaguuucuuagcuauaucuugcggggauac

SEQ ID NO: 947 - RNA, 350 nt, artificial sequence
  synthetic construct
gcaacaaauugaaaauauccugcaauugauagaugaucugaugguugaugggcagcuuguuaucgcacacuugcaucaaauagucucuuauaucuuucaauugcaaaugcaacccuuuaaggccuaauaacugauuaguaauccucugagauaaaguucccacuguagugucuuugauaucucuuaguaaauguucuacuccgacuucuucagcuucuucugcgccuauuucgcucgggacguguucaaacguuuuagaugugggugagccaucaucguggacuucuucuaccgcuugguaugcuucaguaggaagccccagaucuuuagguuucgcaucuauaaucacc

SEQ ID NO: 948 - RNA, 351 nt, artificial sequence
  synthetic construct
gucuucugcgucucuguuggugaguuuguuguugauuagguugugcaaugcaacgauagaucgaacgagagcuccuaaauaaacuacaagcauuugaucguuauuuuuaacauaaaacgaauuguugaacgcauccugauuuauaucgggcaacaaauugaaaauauccugcaauugauagaugaucugaugguugaugggcagcuuguuaucgcacacuugcaucaaauagucucuuauaucuuucaauugcaaaugcaacccuuuaaggccuaauaacugauuaguaauccucugagauaaaguucccacuguagugucuuugauaucucuuaguaaauguucuacucc

SEQ ID NO: 949 - RNA, 351 nt, artificial sequence
  synthetic construct
guauuucgcucgggacguguucaaacguuuuagaugugggugagccaucaucguggacuucuucuaccgcuugguaugcuucaguaggaagccccagaucuuuagguuucgcaucuauaaucaccaagacugaauuggggcaguaucuucgaacuaauucguugauagcgaugucguuuugguguaauuuaggaccggugugguaccaaccaacgacgcguucucuagcguugacuuucuuaaacaugccguacauguuuuccagguagucgugguccaagaaccauacagauuugucuuugucguccucaucgaaagggacugcgaaacuguuggacacaucuaagacuc

SEQ ID NO: 950 - RNA, 352 nt, artificial sequence
  synthetic construct
guaucuucgaacuaauucguugauagcgaugucguuuugguguaauuuaggaccggugugguaccaaccaacgacgcguucucuagcguugacuuucuuaaacaugccguacauguuuuccagguagucgugguccaagaaccauacagauuugucuuugucguccucaucgaaagggacugcgaaacuguuggacacaucuaagacuccuuuggcccuccagcaaccgaguagaacaccgacaacacgcuuuugauugccgauuuugcccauccgauugaaaugguccacuacgcugagaagcaccagcgggugcacuaucaccuuagucguuguaaccucuguacucggc

SEQ ID NO: 951 - RNA, 351 nt, artificial sequence
  synthetic construct
guauuuuuucuucucguccuucuucgcuuccuucucuuuguccguuuuuuccuuauccuugucuuugcuaucuuuauccuuguuguccuuuuucuccuccuuuuugccuucuucugcgucucuguuggugaguuuguuguugauuagguugugcaaugcaacgauagaucgaacgagagcuccuaaauaaacuacaagcauuugaucguuauuuuuaacauaaaacgaauuguugaacgcauccugauuuauaucgggcaacaaauugaaaauauccugcaauugauagaugaucugaugguugaugggcagcuuguuaucgcacacuugcaucaaauagucucuuauauc

SEQ ID NO: 952 - RNA, 352 nt, artificial sequence
  synthetic construct
guuucuucucguccuucuucgcuuccuucucuuuguccguuuuuuccuuauccuugucuuugcuaucuuuauccuuguuguccuuuuucuccuccuuuuugccuucuucugcgucucuguuggugaguuuguuguugauuagguugugcaaugcaacgauagaucgaacgagagcuccuaaauaaacuacaagcauuugaucguuauuuuuaacauaaaacgaauuguugaacgcauccugauuuauaucgggcaacaaauugaaaauauccugcaauugauagaugaucugaugguugaugggcagcuuguuaucgcacacuugcaucaaauagucucuuauaucuuucac

SEQ ID NO: 953 - RNA, 352 nt, artificial sequence
  synthetic construct
guucuucucguccuucuucgcuuccuucucuuuguccguuuuuuccuuauccuugucuuugcuaucuuuauccuuguuguccuuuuucuccuccuuuuugccuucuucugcgucucuguuggugaguuuguuguugauuagguugugcaaugcaacgauagaucgaacgagagcuccuaaauaaacuacaagcauuugaucguuauuuuuaacauaaaacgaauuguugaacgcauccugauuuauaucgggcaacaaauugaaaauauccugcaauugauagaugaucugaugguugaugggcagcuuguuaucgcacacuugcaucaaauagucucuuauaucuuucaac

SEQ ID NO: 954 - RNA, 351 nt, artificial sequence
  synthetic construct
guauccuugucuuugcuaucuuuauccuuguuguccuuuuucuccuccuuuuugccuucuucugcgucucuguuggugaguuuguuguugauuagguugugcaaugcaacgauagaucgaacgagagcuccuaaauaaacuacaagcauuugaucguuauuuuuaacauaaaacgaauuguugaacgcauccugauuuauaucgggcaacaaauugaaaauauccugcaauugauagaugaucugaugguugaugggcagcuuguuaucgcacacuugcaucaaauagucucuuauaucuuucaauugcaaaugcaacccuuuaaggccuaauaacugauuaguaauccuc

SEQ ID NO: 955 - RNA, 352 nt, artificial sequence
  synthetic construct
guccuaaauaaacuacaagcauuugaucguuauuuuuaacauaaaacgaauuguugaacgcauccugauuuauaucgggcaacaaauugaaaauauccugcaauugauagaugaucugaugguugaugggcagcuuguuaucgcacacuugcaucaaauagucucuuauaucuuucaauugcaaaugcaacccuuuaaggccuaauaacugauuaguaauccucugagauaaaguucccacuguagugucuuugauaucucuuaguaaauguucuacuccgacuucuucagcuucuucugcgccuauuucgcucgggacguguucaaacguuuuagaugugggugagccauc

SEQ ID NO: 956 - RNA, 351 nt, artificial sequence
  synthetic construct
guaauaacugauuaguaauccucugagauaaaguucccacuguagugucuuugauaucucuuaguaaauguucuacuccgacuucuucagcuucuucugcgccuauuucgcucgggacguguucaaacguuuuagaugugggugagccaucaucguggacuucuucuaccgcuugguaugcuucaguaggaagccccagaucuuuagguuucgcaucuauaaucaccaagacugaauuggggcaguaucuucgaacuaauucguugauagcgaugucguuuugguguaauuuaggaccggugugguaccaaccaacgacgcguucucuagcguugacuuucuuaaacaugc

SEQ ID NO: 957 - RNA, 352 nt, artificial sequence
  synthetic construct
guuuuuccucuaauaauugcuccauuguauuaacauguuugcaccaaucauugagucuuguuaccauacuggagaucugagugcgaucuaaaacucucgguugaacccaugucauguuuaccguacuggcaaccugaucaauugccccuuuaacuaagccuugugaaagcgccuucauuaccagcagcucaauuucauugagagguaaccucguuucuuuugaaauuuccgcaaauguuaacugccuguuaugggacggucuguuaaaugucaucuccaucagacauaauaaggauaucuucugucuuaagaauaguuccucgguggccaaaucggcuauagacgaccacuc

SEQ ID NO: 958 - RNA, 352 nt, artificial sequence
  synthetic construct
guuccucuaauaauugcuccauuguauuaacauguuugcaccaaucauugagucuuguuaccauacuggagaucugagugcgaucuaaaacucucgguugaacccaugucauguuuaccguacuggcaaccugaucaauugccccuuuaacuaagccuugugaaagcgccuucauuaccagcagcucaauuucauugagagguaaccucguuucuuuugaaauuuccgcaaauguuaacugccuguuaugggacggucuguuaaaugucaucuccaucagacauaauaaggauaucuucugucuuaagaauaguuccucgguggccaaaucggcuauagacgaccacugagc

SEQ ID NO: 959 - RNA, 351 nt, artificial sequence
  synthetic construct
guacaaaguuaauauuucacuggcuuuuuccucuaauaauugcuccauuguauuaacauguuugcaccaaucauugagucuuguuaccauacuggagaucugagugcgaucuaaaacucucgguugaacccaugucauguuuaccguacuggcaaccugaucaauugccccuuuaacuaagccuugugaaagcgccuucauuaccagcagcucaauuucauugagagguaaccucguuucuuuugaaauuuccgcaaauguuaacugccuguuaugggacggucuguuaaaugucaucuccaucagacauaauaaggauaucuucugucuuaagaauaguuccucgguggc

SEQ ID NO: 960 - RNA, 350 nt, artificial sequence
  synthetic construct
gucuuuucuaggaaagcgaucgcgucuuucgguuccuuguacuguucgacgacaauggccgcuauuucgaccaaagacaaaggauugauuuuauuuucgaacguuugaauaaaauugugauacagcuggauuagguuguccgcuuucuguaauucugguuucuuuauaaacacuaguaauuugaggguuaguugaugccauaauuuuuuauuauggagcuccucaaguucugcccacucagagcccaauuccuucggacuuucuuuuuguuguuuagcaagauaaucacuaacauuagacgguugcaccgcagcugcagccauuuucugugaugacaagacaaaaauuuc

SEQ ID NO: 961 - RNA, 350 nt, artificial sequence
  synthetic construct
gagguaaccucguuucuuuugaaauuuccgcaaauguuaacugccuguuaugggacggucuguuaaaugucaucuccaucagacauaauaaggauaucuucugucuuaagaauaguuccucgguggccaaaucggcuauagacgaccacugaguuuucauggcuucgaauuuccuuauguuuccggaauugaaggcguacaaaagcucgaugagccaagcauucucgguugccuucagagacucuaauacaggaugggccagaagcucuccgagauuguaaacucccucucccagcaaagcugcuaagcccaagaaaaacgcaugcugcacuuucacuucggucuucaac

SEQ ID NO: 962 - RNA, 352 nt, artificial sequence
  synthetic construct
gagguaaccucguuucuuuugaaauuuccgcaaauguuaacugccuguuaugggacggucuguuaaaugucaucuccaucagacauaauaaggauaucuucugucuuaagaauaguuccucgguggccaaaucggcuauagacgaccacugaguuuucauggcuucgaauuuccuuauguuuccggaauugaaggcguacaaaagcucgaugagccaagcauucucgguugccuucagagacucuaauacaggaugggccagaagcucuccgagauuguaaacucccucucccagcaaagcugcuaagcccaagaaaaacgcaugcugcacuuucacuucggucuucaacgc

SEQ ID NO: 963 - RNA, 350 nt, artificial sequence
  synthetic construct
gcucgaugagccaagcauucucgguugccuucagagacucuaauacaggaugggccagaagcucuccgagauuguaaacucccucucccagcaaagcugcuaagcccaagaaaaacgcaugcugcacuuucacuucggucuucaacgauuccacaucuaugcagcccaaauaccucaaagcggugcgauaauauugcgcauggucuccuugaauucuguaauauugcgaggcgaguaaauaaaaucucccguguacugggguaaccccguccgcauuaucaaaggucgcuucgaccuccucgaugaucuuuuugguggugucuaaaucguuuaacuuaucaagguagauc

SEQ ID NO: 964 - RNA, 351 nt, artificial sequence
  synthetic construct
gauugcgaggcgaguaaauaaaaucucccguguacugggguaaccccguccgcauuaucaaaggucgcuucgaccuccucgaugaucuuuuugguggugucuaaaucguuuaacuuaucaagguagaucuguccuucgaggacuuugcacagguuuugggcguccggguugauuuucacuuuggguucagucuuuucuaggaaagcgaucgcgucuuucgguuccuuguacuguucgacgacaauggccgcuauuucgaccaaagacaaaggauugauuuuauuuucgaacguuugaauaaaauugugauacagcuggauuagguuguccgcuuucuguaauucugguuuc

SEQ ID NO: 965 - RNA, 352 nt, artificial sequence
  synthetic construct
gagggcaucuaauuccugcuugcuuucuacgaaucucgaucugucguuagcgucaauaagaaauacgauagcaucuacggcugggaaguaauccuuccacacucuucgggcuugcgaauggccuccuagaucgaacgugguaaaccucauguuuccgauggacaauuccucggaggucggaugcaaugugggcaagugcugggccagucuaucaucuuuaagcauauguaauaaggucguuuuaccagcguuguccaguccuaaaaagagcaauuuuccggacuucuuccauaauccuaaguaucccagcacucccgugaaccaaucccauaugaacauuucgauuaauugc

SEQ ID NO: 966 - RNA, 350 nt, artificial sequence
  synthetic construct
gccuagaaucaacacggggcaauuggcuagagucucguccguuaacagggcaucuaauuccugcuugcuuucuacgaaucucgaucugucguuagcgucaauaagaaauacgauagcaucuacggcugggaaguaauccuuccacacucuucgggcuugcgaauggccuccuagaucgaacgugguaaaccucauguuuccgauggacaauuccucggaggucggaugcaaugugggcaagugcugggccagucuaucaucuuuaagcauauguaauaaggucguuuuaccagcguuguccaguccuaaaaagagcaauuuuccggacuucuuccauaauccuaaguauc

SEQ ID NO: 967 - RNA, 350 nt, artificial sequence
  synthetic construct
guaaucaauguacugcgccaaccaacgaaaacccuccccguaucccugccucuucaauauggagcacaugaaaagcucgagaggccuuccggguagaucggaccgagcgacuuuaccuuuaccggucguuuggccauacaacgaguaaacguuucgcaauucauccucagaggcggcguccggcagaucgauuuuauugccuagaaucaacacggggcaauuggcuagagucucguccguuaacagggcaucuaauuccugcuugcuuucuacgaaucucgaucugucguuagcgucaauaagaaauacgauagcaucuacggcugggaaguaauccuuccacacucuuc

SEQ ID NO: 968 - RNA, 352 nt, artificial sequence
  synthetic construct
guuuauugccuagaaucaacacggggcaauuggcuagagucucguccguuaacagggcaucuaauuccugcuugcuuucuacgaaucucgaucugucguuagcgucaauaagaaauacgauagcaucuacggcugggaaguaauccuuccacacucuucgggcuugcgaauggccuccuagaucgaacgugguaaaccucauguuuccgauggacaauuccucggaggucggaugcaaugugggcaagugcugggccagucuaucaucuuuaagcauauguaauaaggucguuuuaccagcguuguccaguccuaaaaagagcaauuuuccggacuucuuccauaauccuac

SEQ ID NO: 969 - RNA, 352 nt, artificial sequence
  synthetic construct
guauugccuagaaucaacacggggcaauuggcuagagucucguccguuaacagggcaucuaauuccugcuugcuuucuacgaaucucgaucugucguuagcgucaauaagaaauacgauagcaucuacggcugggaaguaauccuuccacacucuucgggcuugcgaauggccuccuagaucgaacgugguaaaccucauguuuccgauggacaauuccucggaggucggaugcaaugugggcaagugcugggccagucuaucaucuuuaagcauauguaauaaggucguuuuaccagcguuguccaguccuaaaaagagcaauuuuccggacuucuuccauaauccuaagc

SEQ ID NO: 970 - RNA, 351 nt, artificial sequence
  synthetic construct
gugacggucgacguagaucuguccuucgguaauauaaccggucaaaucgggaaucgggugaguaauaucgucguugggcauggucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaacacgugcuucucgcauugauaggccaaaaauucggcagccguuagagccaaacggggcgugaugauucucucaauaguaggauc

SEQ ID NO: 971 - RNA, 352 nt, artificial sequence
  synthetic construct
gagcugacggucgacguagaucuguccuucgguaauauaaccggucaaaucgggaaucgggugaguaauaucgucguugggcauggucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaacacgugcuucucgcauugauaggccaaaaauucggcagccguuagagccaaacggggcgugaugauucucucaauaguaggc

SEQ ID NO: 972 - RNA, 352 nt, artificial sequence
  synthetic construct
gucgccggugaauucgcacacgguguuuuuggcgucgauucccgaaguaccuucgaacacuuguacuacggcuuuggagccgcucaccuccaauacuugaccggaucguagacugccaucggccaguuugagcuggacgauuucguugaauuucggaaauuugacaucuucgaggauuaccaacgguccguugacaccagacacuguuuuguaagugagccucggcugggauacgaagucucuggacacggccaaaacgugcuccugugcggccuguuuugcguuuaacgucgauggguaagacaucuucucugcgugaagaacgauacgucuaacacaaaccgcaaaaaac

SEQ ID NO: 973 - RNA, 352 nt, artificial sequence
  synthetic construct
gaauauaaccggucaaaucgggaaucgggugaguaauaucgucguugggcauggucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaacacgugcuucucgcauugauaggccaaaaauucggcagccguuagagccaaacggggcgugaugauucucucaauaguaggaucguuggccaaauucaagaacaaacauacguc

SEQ ID NO: 974 - RNA, 351 nt, artificial sequence
  synthetic construct
gaaaucgggaaucgggugaguaauaucgucguugggcauggucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaacacgugcuucucgcauugauaggccaaaaauucggcagccguuagagccaaacggggcgugaugauucucucaauaguaggaucguuggccaaauucaagaacaaacauacguucuccaucgaacc

SEQ ID NO: 975 - RNA, 352 nt, artificial sequence
  synthetic construct
guagaaacgucagagugaucuuuccuggucauucccucgccgauggcggacuucaugagacgagacagcgacgguaagacguugaucgguggguaaauuugccuguugugcagcugacggucgacguagaucuguccuucgguaauauaaccggucaaaucgggaaucgggugaguaauaucgucguugggcauggucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcgc

SEQ ID NO: 976 - RNA, 352 nt, artificial sequence
  synthetic construct
guaugaaguucuucucgaacuuggucaggaacuccagguagagcaaaucgucgggcgucagggccuccucucccaccacggccuucaucgccuggacguccuuaccaauggcguagcaagcguacaacugguuagaaacgucagagugaucuuuccuggucauucccucgccgauggcggacuucaugagacgagacagcgacgguaagacguugaucgguggguaaauuugccuguugugcagcugacggucgacguagaucuguccuucgguaauauaaccggucaaaucgggaaucgggugaguaauaucgucguugggcauggucaagauggggauuugggugauggc

SEQ ID NO: 977 - RNA, 352 nt, artificial sequence
  synthetic construct
gcagcugacggucgacguagaucuguccuucgguaauauaaccggucaaaucgggaaucgggugaguaauaucgucguugggcauggucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaacacgugcuucucgcauugauaggccaaaaauucggcagccguuagagccaaacggggcgugaugauucucucaauaguagc

SEQ ID NO: 978 - RNA, 350 nt, artificial sequence
  synthetic construct
guaauauaaccggucaaaucgggaaucgggugaguaauaucgucguugggcauggucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaacacgugcuucucgcauugauaggccaaaaauucggcagccguuagagccaaacggggcgugaugauucucucaauaguaggaucguuggccaaauucaagaacaaacauac

SEQ ID NO: 979 - RNA, 351 nt, artificial sequence
  synthetic construct
gugaguaauaucgucguugggcauggucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaacacgugcuucucgcauugauaggccaaaaauucggcagccguuagagccaaacggggcgugaugauucucucaauaguaggaucguuggccaaauucaagaacaaacauacguucuccaucgaaccguucuccucgaaauc

SEQ ID NO: 980 - RNA, 351 nt, artificial sequence
  synthetic construct
guagucuuucaacauagcaggcuccucuuuaaugcuguccuuaauuuucucugcgggagccgccaccgaacaaccggagcucguucccaaaaccguuuucacuguucccgccguguugguguugucguucauuuucccuuccucagacuucucguuuuggcucugauuaccauaauacugucgguuggguguuuuguuggauguauuccuaugcuuuugauucgcugaauucugcuguacuuggaaauuuacgggucucugaauaggcgucggauaccuuugcauauuagagcuuuggggcccgccuacgccuugauacaaauuauauuucuguugggccgucgggcucgc

SEQ ID NO: 981 - RNA, 351 nt, artificial sequence
  synthetic construct
gcauccggaguguccuucccuugggcgaaaacguucgaauccagaggcgugccggagaacccgaucugauucucgucguucuccuguucggaugucucccacacuuuuuucaccgacgcgaucuuguaauccaaacugucgaccguauuguuaccgccggucaucguauggauggguuucgaggcgaaguucuucgaacucuuguccucggcgaauugcagaucggcggugaaaaaguccaauuucaugucggccgaguccuccuugaacagcugcagcggcaugcuguccgauuuguccggcuucgcuugcagcagaucguucauguuggguuuauuaaaacuagaaauc

SEQ ID NO: 982 - RNA, 351 nt, artificial sequence
  synthetic construct
guccggaguguccuucccuugggcgaaaacguucgaauccagaggcgugccggagaacccgaucugauucucgucguucuccuguucggaugucucccacacuuuuuucaccgacgcgaucuuguaauccaaacugucgaccguauuguuaccgccggucaucguauggauggguuucgaggcgaaguucuucgaacucuuguccucggcgaauugcagaucggcggugaaaaaguccaauuucaugucggccgaguccuccuugaacagcugcagcggcaugcuguccgauuuguccggcuucgcuugcagcagaucguucauguuggguuuauuaaaacuagaaaucac

SEQ ID NO: 983 - RNA, 352 nt, artificial sequence
  synthetic construct
gcggaguguccuucccuugggcgaaaacguucgaauccagaggcgugccggagaacccgaucugauucucgucguucuccuguucggaugucucccacacuuuuuucaccgacgcgaucuuguaauccaaacugucgaccguauuguuaccgccggucaucguauggauggguuucgaggcgaaguucuucgaacucuuguccucggcgaauugcagaucggcggugaaaaaguccaauuucaugucggccgaguccuccuugaacagcugcagcggcaugcuguccgauuuguccggcuucgcuugcagcagaucguucauguuggguuuauuaaaacuagaaaucacagc

SEQ ID NO: 984 - RNA, 351 nt, artificial sequence
  synthetic construct
guccuucccuugggcgaaaacguucgaauccagaggcgugccggagaacccgaucugauucucgucguucuccuguucggaugucucccacacuuuuuucaccgacgcgaucuuguaauccaaacugucgaccguauuguuaccgccggucaucguauggauggguuucgaggcgaaguucuucgaacucuuguccucggcgaauugcagaucggcggugaaaaaguccaauuucaugucggccgaguccuccuugaacagcugcagcggcaugcuguccgauuuguccggcuucgcuugcagcagaucguucauguuggguuuauuaaaacuagaaaucacagaauuguc

SEQ ID NO: 985 - RNA, 352 nt, artificial sequence
  synthetic construct
gaucguauuuacagggggcgugcugccgucgagcaggcuuuugucuugcagcggacugguuuuuccgaucaucuuuucauugccaggacucgugacuccuugcgaaggcgaaugagcggauuccaaagccuuaacggcguccauggacgguccgagcauaccgucgugcuccacuuuccucaacuggggccccaacggcuuaucccaagcgcacgucgacaugguggcgggcauaccguuaucuuucaucacguagacguucauguuguucauaucguugacgucuccgaucggaugguucugcuguuguugcugcugcugcugcuguuguuguuguuguaggauauuuauc

SEQ ID NO: 986 - RNA, 351 nt, artificial sequence
  synthetic construct
gacuguccggacggccggcguuucgcgaaccgggcgccgauuugaaguugguguuuucgaauauuaucguauuuacagggggcgugcugccgucgagcaggcuuuugucuugcagcggacugguuuuuccgaucaucuuuucauugccaggacucgugacuccuugcgaaggcgaaugagcggauuccaaagccuuaacggcguccauggacgguccgagcauaccgucgugcuccacuuuccucaacuggggccccaacggcuuaucccaagcgcacgucgacaugguggcgggcauaccguuaucuuucaucacguagacguucauguuguucauaucguugacgucuc

SEQ ID NO: 987 - RNA, 351 nt, artificial sequence
  synthetic construct
gauuaccauaauacugucgguuggguguuuuguuggauguauuccuaugcuuuugauucgcugaauucugcuguacuuggaaauuuacgggucucugaauaggcgucggauaccuuugcauauuagagcuuuggggcccgccuacgccuugauacaaauuauauuucuguugggccgucgggcucgauugcggcgggggauguuuauuguucugucucgauuucggcgagggaaucugaggaccuguauugaagaccgaagacaacaccuccuggcugcuggggcucuucaauugcugcggccugcccgauuggucgccgaucugguggcuguugacgcccuucauguagc

SEQ ID NO: 988 - RNA, 351 nt, artificial sequence
  synthetic construct
gcguugauuucauuuuguuuaucuaccccuucucucguuucaucuaauauucguucgauaucuucaauguucauagcagcauugaugguuuuaagggcuucauugccuguucuaaggccuucuacgacuuguguuuccacuugggcgaauucaauaucaccagccaaguuuucuagauuguucaguugauuaucaagcuuugauaggaguugcucuugguaccguuucuuuuuaagcaguaauuuagcccuguccuuuuggccauuauucaauaguuuuuuagcuaacucucuguccuuaccaagggauaauucuauucuccuuugguacuguuuuacuuuaucucucugc

SEQ ID NO: 989 - RNA, 351 nt, artificial sequence
  synthetic construct
guucguucgauaucuucaauguucauagcagcauugaugguuuuaagggcuucauugccuguucuaaggccuucuacgacuuguguuuccacuugggcgaauucaauaucaccagccaaguuuucuagauuguucaguugauuaucaagcuuugauaggaguugcucuugguaccguuucuuuuuaagcaguaauuuagcccuguccuuuuggccauuauucaauaguuuuuuagcuaacucucuguccuuaccaagggauaauucuauucuccuuugguacuguuuuacuuuaucucucugcuguuuuaauugcaauacagcuuugucuuguucuguuacucuacucggc

SEQ ID NO: 990 - RNA, 351 nt, artificial sequence
  synthetic construct
gauuccucuucaacagcugccucaucuucaucuguuaguuggccgcuaaguaauucguugauuucauuuuguuuaucuaccccuucucucguuucaucuaauauucguucgauaucuucaauguucauagcagcauugaugguuuuaagggcuucauugccuguucuaaggccuucuacgacuuguguuuccacuugggcgaauucaauaucaccagccaaguuuucuagauuguucaguugauuaucaagcuuugauaggaguugcucuugguaccguuucuuuuuaagcaguaauuuagcccuguccuuuuggccauuauucaauaguuuuuuagcuaacucucugucc

SEQ ID NO: 991 - RNA, 351 nt, artificial sequence
  synthetic construct
guaucuucaauguucauagcagcauugaugguuuuaagggcuucauugccuguucuaaggccuucuacgacuuguguuuccacuugggcgaauucaauaucaccagccaaguuuucuagauuguucaguugauuaucaagcuuugauaggaguugcucuugguaccguuucuuuuuaagcaguaauuuagcccuguccuuuuggccauuauucaauaguuuuuuagcuaacucucuguccuuaccaagggauaauucuauucuccuuugguacuguuuuacuuuaucucucugcuguuuuaauugcaauacagcuuugucuuguucuguuacucuacucggcuuuuucuuc

SEQ ID NO: 992 - RNA, 351 nt, artificial sequence
  synthetic construct
gauauucguucgauaucuucaauguucauagcagcauugaugguuuuaagggcuucauugccuguucuaaggccuucuacgacuuguguuuccacuugggcgaauucaauaucaccagccaaguuuucuagauuguucaguugauuaucaagcuuugauaggaguugcucuugguaccguuucuuuuuaagcaguaauuuagcccuguccuuuuggccauuauucaauaguuuuuuagcuaacucucuguccuuaccaagggauaauucuauucuccuuugguacuguuuuacuuuaucucucugcuguuuuaauugcaauacagcuuugucuuguucuguuacucuacuc

SEQ ID NO: 993 - RNA, 350 nt, artificial sequence
  synthetic construct
guucuaaggccuucuacgacuuguguuuccacuugggcgaauucaauaucaccagccaaguuuucuagauuguucaguugauuaucaagcuuugauaggaguugcucuugguaccguuucuuuuuaagcaguaauuuagcccuguccuuuuggccauuauucaauaguuuuuuagcuaacucucuguccuuaccaagggauaauucuauucuccuuugguacuguuuuacuuuaucucucugcuguuuuaauugcaauacagcuuugucuuguucuguuacucuacucggcuuuuucuucuuaccaaaaaugauacccaucguaaagucuguuugaaaauaugcuucucc

SEQ ID NO: 994 - RNA, 352 nt, artificial sequence
  synthetic construct
guuuaucuaccccuucucucguuucaucuaauauucguucgauaucuucaauguucauagcagcauugaugguuuuaagggcuucauugccuguucuaaggccuucuacgacuuguguuuccacuugggcgaauucaauaucaccagccaaguuuucuagauuguucaguugauuaucaagcuuugauaggaguugcucuugguaccguuucuuuuuaagcaguaauuuagcccuguccuuuuggccauuauucaauaguuuuuuagcuaacucucuguccuuaccaagggauaauucuauucuccuuugguacuguuuuacuuuaucucucugcuguuuuaauugcaauac

SEQ ID NO: 995 - RNA, 351 nt, artificial sequence
  synthetic construct
gaucuaauauucguucgauaucuucaauguucauagcagcauugaugguuuuaagggcuucauugccuguucuaaggccuucuacgacuuguguuuccacuugggcgaauucaauaucaccagccaaguuuucuagauuguucaguugauuaucaagcuuugauaggaguugcucuugguaccguuucuuuuuaagcaguaauuuagcccuguccuuuuggccauuauucaauaguuuuuuagcuaacucucuguccuuaccaagggauaauucuauucuccuuugguacuguuuuacuuuaucucucugcuguuuuaauugcaauacagcuuugucuuguucuguuacuc

SEQ ID NO: 996 - RNA, 352 nt, artificial sequence
  synthetic construct
guucaucuucuucuucuuuggcaguuucguuaacuuguacuucaggcuguuccauaggcacugugggcaaaucuucgcuaauuauugcugcuaauuccucuucaacagcugccucaucuucaucuguuaguuggccgcuaaguaauucguugauuucauuuuguuuaucuaccccuucucucguuucaucuaauauucguucgauaucuucaauguucauagcagcauugaugguuuuaagggcuucauugccuguucuaaggccuucuacgacuuguguuuccacuugggcgaauucaauaucaccagccaaguuuucuagauuguucaguugauuaucaagcuuugauac

SEQ ID NO: 997 - RNA, 351 nt, artificial sequence
  synthetic construct
gaauuccucuucaacagcugccucaucuucaucuguuaguuggccgcuaaguaauucguugauuucauuuuguuuaucuaccccuucucucguuucaucuaauauucguucgauaucuucaauguucauagcagcauugaugguuuuaagggcuucauugccuguucuaaggccuucuacgacuuguguuuccacuugggcgaauucaauaucaccagccaaguuuucuagauuguucaguugauuaucaagcuuugauaggaguugcucuugguaccguuucuuuuuaagcaguaauuuagcccuguccuuuuggccauuauucaauaguuuuuuagcuaacucucuguc

SEQ ID NO: 998 - RNA, 350 nt, artificial sequence
  synthetic construct
guaagcuaauacaggaaccuucucuuucucuuuuuccuuaguuuuugguuucuugaccuucuccuuuucuuccuccuccucauccguuacuacuuccccuucaucuucuucuucuuuggcaguuucguuaacuuguacuucaggcuguuccauaggcacugugggcaaaucuucgcuaauuauugcugcuaauuccucuucaacagcugccucaucuucaucuguuaguuggccgcuaaguaauucguugauuucauuuuguuuaucuaccccuucucucguuucaucuaauauucguucgauaucuucaauguucauagcagcauugaugguuuuaagggcuucauugc

SEQ ID NO: 999 - RNA, 352 nt, artificial sequence
  synthetic construct
gagcgagcccgacacccugagaguggcuaauugguucuucauuuguagcauuacggaguugaggugggcuuuggacguguagaucuuguugauggcuuugcgagaguugaugauuuccuuggcuaauaucaggcagguguccuugucguuuuucuuggcugcuuccuuuagggaucgcuugacuuuuucuucuucucgcuggauggaucguauuugccuuuccaguugguagccuuccuugcgcaguuugugguuccacucuguaaccaagucuuucggacuccucucaggcguuuucccgaaaagucccauguuucccgaguuuuugcuguuuuuaaaaaauacuaauguc

SEQ ID NO: 1000 - RNA, 352 nt, artificial sequence
  synthetic construct
guuucaucaucucuuuggacaugucuugcaucgucugcgccaccuccggcacgcguacgagccucugcaucgucugcaugaccuccguggauuuuugcagcgagcccgacacccugagaguggcuaauugguucuucauuuguagcauuacggaguugaggugggcuuuggacguguagaucuuguugauggcuuugcgagaguugaugauuuccuuggcuaauaucaggcagguguccuugucguuuuucuuggcugcuuccuuuagggaucgcuugacuuuuucuucuucucgcuggauggaucguauuugccuuuccaguugguagccuuccuugcgcaguuugugguc

SEQ ID NO: 1001 - RNA, 352 nt, artificial sequence
  synthetic construct
gaaucuccucuucguucuccuccuccucgggcuccuccaccgacgucgccggcaccggagucaccuucucggccagcuccugcggcggcagcggcgccuccccgaucuucccuuccguuaucucgaacaacacuuuaucuaucucgguuugcgccgcuuccuccaucuccucggaguccucgagauccuccaugguuucguccagcaucuccucgaugaugccggcuuucaucaucucuuuggacaugucuugcaucgucugcgccaccuccggcacgcguacgagccucugcaucgucugcaugaccuccguggauuuuugcagcgagcccgacacccugagaguggcuac

SEQ ID NO: 1002 - RNA, 352 nt, artificial sequence
  synthetic construct
gcagcgagcccgacacccugagaguggcuaauugguucuucauuuguagcauuacggaguugaggugggcuuuggacguguagaucuuguugauggcuuugcgagaguugaugauuuccuuggcuaauaucaggcagguguccuugucguuuuucuuggcugcuuccuuuagggaucgcuugacuuuuucuucuucucgcuggauggaucguauuugccuuuccaguugguagccuuccuugcgcaguuugugguuccacucuguaaccaagucuuucggacuccucucaggcguuuucccgaaaagucccauguuucccgaguuuuugcuguuuuuaaaaaauacuaaugc

SEQ ID NO: 1003 - RNA, 352 nt, artificial sequence
  synthetic construct
guucaucaucucuuuggacaugucuugcaucgucugcgccaccuccggcacgcguacgagccucugcaucgucugcaugaccuccguggauuuuugcagcgagcccgacacccugagaguggcuaauugguucuucauuuguagcauuacggaguugaggugggcuuuggacguguagaucuuguugauggcuuugcgagaguugaugauuuccuuggcuaauaucaggcagguguccuugucguuuuucuuggcugcuuccuuuagggaucgcuugacuuuuucuucuucucgcuggauggaucguauuugccuuuccaguugguagccuuccuugcgcaguuugugguuc

SEQ ID NO: 1004 - RNA, 352 nt, artificial sequence
  synthetic construct
gaaaucuccucuucguucuccuccuccucgggcuccuccaccgacgucgccggcaccggagucaccuucucggccagcuccugcggcggcagcggcgccuccccgaucuucccuuccguuaucucgaacaacacuuuaucuaucucgguuugcgccgcuuccuccaucuccucggaguccucgagauccuccaugguuucguccagcaucuccucgaugaugccggcuuucaucaucucuuuggacaugucuugcaucgucugcgccaccuccggcacgcguacgagccucugcaucgucugcaugaccuccguggauuuuugcagcgagcccgacacccugagaguggcuc

SEQ ID NO: 1005 - RNA, 352 nt, artificial sequence
  synthetic construct
guaauuucaucaaaacaagcgucgcaaacucuaaccucuuuuucuauuccguauuuggguaaaguagacguuuuagaagugcacuguccacaaaauacuugaccgcaggcucugcaaugguguuuucucuguagcacgcugaauugcacucugcaucuguggcaaacgucgccgucagcccauucuggagccguaucggacgaaaacaucgcguccgauucucgaagcgcagggaacuuacgaccuuccauuuucauuguauucauaagguccuugagagcaccaugcuuaggauuuuuucugaaugcgaaauuccaaguuugaaucaacucaagaaguuuacugcggacac

SEQ ID NO: 1006 - RNA, 352 nt, artificial sequence
  synthetic construct
guuguucuugucucaucugcauuucccucuccugcucuugaauccuuuggagcgccaacugucuuugguauugaagauauuccuguuucuuuuuccucauaacauccaacuugugcgccauuugcauuuggcgcauccucuccuguuccucagcuucucuucucaauuuuucguuauguucuucgcggagagcauccaaagccgcucuugcguccuucacuugggucauuuuauccuguaggcacucguaauggaugcggcugucgucgugcucuugaauauaaugaagcaaucgagaaugcauagcuguuauguucaugaacaaaguuuguacgcuagugucauucgcgac

SEQ ID NO: 1007 - RNA, 352 nt, artificial sequence
  synthetic construct
gaucaacucaagaaguuuacugcggacauuuucgugugggguaguuuucgacaacucauguaggaaaucacagaaugguuuagucguuaauucuucaugaaauacagugccacaauuuuuuaccaugcuuuccaaaaccaguagggcauauaaagcuguaugaggauuuucugaacugaguuucuucuuuaaugaauucaaagcaaauuucggcugaauaucaucuugucuaaucaagucgcacauuugcagcguagauaccaaauccugcuccauuaacaaauggcuagucgcuuuuucaagcaaaguaucaaaauuccuguggcgaaacauucugaaagaaaagugauuc

SEQ ID NO: 1008 - RNA, 351 nt, artificial sequence
  synthetic construct
gagcuacagcaacuugauucggcauauuuugagacgacaucauguguuguggaaauggauaaguguuguaguugcucauaggagguccagcguuagggggaaaagguuguccgugcacaggagagcuaauauaaccauauugaggcaucauauacugcuguuucuguuguucuugucucaucugcauuucccucuccugcucuugaauccuuuggagcgccaacugucuuugguauugaagauauuccuguuucuuuuuccucauaacauccaacuugugcgccauuugcauuuggcgcauccucuccuguuccucagcuucucuucucaauuuuucguuauguucuucgc

SEQ ID NO: 1009 - RNA, 351 nt, artificial sequence
  synthetic construct
gagagauucccaguaagaucuguuuagauauuuggcuaacuccguauucgauucuacuuguugagguggagauugcggucucucaacaggcaucgguucagcuuuugcagaauauaaaguaguuguagaucggguuuuuucuuuuucuuuagccuccgcuucagacuggcucaaagccaaugcuaacuguaauuccucuucuucccuuaauucuucgucgcuuuuuuuaggcggaucuuguuuuuguugugccaaagagcuguucaaauauucuucagguaaaucggucucgcuugauccccuggacuucggcgcagaugaggguuucauaauuucaucaaaacaagcguc

SEQ ID NO: 1010 - RNA, 352 nt, artificial sequence
  synthetic construct
guuucuguuguucuugucucaucugcauuucccucuccugcucuugaauccuuuggagcgccaacugucuuugguauugaagauauuccuguuucuuuuuccucauaacauccaacuugugcgccauuugcauuuggcgcauccucuccuguuccucagcuucucuucucaauuuuucguuauguucuucgcggagagcauccaaagccgcucuugcguccuucacuugggucauuuuauccuguaggcacucguaauggaugcggcugucgucgugcucuugaauauaaugaagcaaucgagaaugcauagcuguuauguucaugaacaaaguuuguacgcuagugucauc

SEQ ID NO: 1011 - RNA, 352 nt, artificial sequence
  synthetic construct
guuuccucauaacauccaacuugugcgccauuugcauuuggcgcauccucuccuguuccucagcuucucuucucaauuuuucguuauguucuucgcggagagcauccaaagccgcucuugcguccuucacuugggucauuuuauccuguaggcacucguaauggaugcggcugucgucgugcucuugaauauaaugaagcaaucgagaaugcauagcuguuauguucaugaacaaaguuuguacgcuagugucauucgcgauagaccucccucugcuggaguuacuuuucauucuguuaaugaaaauuucgacgugacccuuuaaagucuucaugaaaucuuccagaucguc

SEQ ID NO: 1012 - RNA, 351 nt, artificial sequence
  synthetic construct
guaaucgaaacuaauuaauucagcaguuugugcuuccccauucgauuugaucuguggacuagcaggaggagcuccaggcuguugcuguugaaacugaggcauucccugauucugcaucccuugauuuugaggaauauuucccggcaaagaaauccuacccugcugcggcacaccuugcggugguaacauuacucccugauucggaggaauauugccuugauguugcugcaugcccugcuguuggggcggcaaauuggguugauuuugcggcggcaucccuuguugcgguauuccugcauugggaggcauucccuguugguugcccggcauauugggcaauccugcugccac

SEQ ID NO: 1013 - RNA, 352 nt, artificial sequence
  synthetic construct
guuucugaaugcgaaauuccaaguuugaaucaacucaagaaguuuacugcggacauuuucgugugggguaguuuucgacaacucauguaggaaaucacagaaugguuuagucguuaauucuucaugaaauacagugccacaauuuuuuaccaugcuuuccaaaaccaguagggcauauaaagcuguaugaggauuuucugaacugaguuucuucuuuaaugaauucaaagcaaauuucggcugaauaucaucuugucuaaucaagucgcacauuugcagcguagauaccaaauccugcuccauuaacaaauggcuagucgcuuuuucaagcaaaguaucaaaauuccugugc

SEQ ID NO: 1014 - RNA, 352 nt, artificial sequence
  synthetic construct
gcugaagaggagcuguggccggcgcggauggacucauaggacgaucguuuuggucguuggauuuaagagauucccaguaagaucuguuuagauauuuggcuaacuccguauucgauucuacuuguugagguggagauugcggucucucaacaggcaucgguucagcuuuugcagaauauaaaguaguuguagaucggguuuuuucuuuuucuuuagccuccgcuucagacuggcucaaagccaaugcuaacuguaauuccucuucuucccuuaauucuucgucgcuuuuuuuaggcggaucuuguuuuuguugugccaaagagcuguucaaauauucuucagguaaaucggc

SEQ ID NO: 1015 - RNA, 352 nt, artificial sequence
  synthetic construct
guuucauuguauucauaagguccuugagagcaccaugcuuaggauuuuuucugaaugcgaaauuccaaguuugaaucaacucaagaaguuuacugcggacauuuucgugugggguaguuuucgacaacucauguaggaaaucacagaaugguuuagucguuaauucuucaugaaauacagugccacaauuuuuuaccaugcuuuccaaaaccaguagggcauauaaagcuguaugaggauuuucugaacugaguuucuucuuuaaugaauucaaagcaaauuucggcugaauaucaucuugucuaaucaagucgcacauuugcagcguagauaccaaauccugcuccauuac

SEQ ID NO: 1016 - RNA, 351 nt, artificial sequence
  synthetic construct
gucaucugauacuugcaucguauuuaauguagccaaccauucugaaaucuuuuguuugcccucaaaauccgacggcaaaaugcucaaucuguucaugguaucgacuaaaucucucacaucaggguguaacugauccauagaacgaauaucuaaucucaauuuguccauuacaguaaugaauagggacacaauaucagcaauacaucuacuaguauuucccuuaucaucuuuaauaguaauaggucugucuuccuuaauucuuucuagggcagccgggcaaucaagccuauauuucuuaacgaaagcaucaacaguaggaaacucaucuccauuaacuugucuaaaugcugc

SEQ ID NO: 1017 - RNA, 352 nt, artificial sequence
  synthetic construct
guaaaucucucacaucaggguguaacugauccauagaacgaauaucuaaucucaauuuguccauuacaguaaugaauagggacacaauaucagcaauacaucuacuaguauuucccuuaucaucuuuaauaguaauaggucugucuuccuuaauucuuucuagggcagccgggcaaucaagccuauauuucuuaacgaaagcaucaacaguaggaaacucaucuccauuaacuugucuaaaugcugcuuuguauugaacuaguagcuuacuacaagcaccaguauacucuuuggcaacaacacaaucccuaauguaugccuuuucaagcuguugcaauguguugauaacugc

SEQ ID NO: 1018 - RNA, 351 nt, artificial sequence
  synthetic construct
gauagggacacaauaucagcaauacaucuacuaguauuucccuuaucaucuuuaauaguaauaggucugucuuccuuaauucuuucuagggcagccgggcaaucaagccuauauuucuuaacgaaagcaucaacaguaggaaacucaucuccauuaacuugucuaaaugcugcuuuguauugaacuaguagcuuacuacaagcaccaguauacucuuuggcaacaacacaaucccuaauguaugccuuuucaagcuguugcaauguguugauaacugcguagagaucugcuaaauuaucguauuuuucccuuucccuugcauugugauacaguuuuacuucuucguaaagc

SEQ ID NO: 1019 - RNA, 351 nt, artificial sequence
  synthetic construct
guaauugugcaauauuuuauugaaagaggcauaagcacucucaagaucaaaaaguaguugucuaaucugugauucugacaauucaucugauacuugcaucguauuuaauguagccaaccauucugaaaucuuuuguuugcccucaaaauccgacggcaaaaugcucaaucuguucaugguaucgacuaaaucucucacaucaggguguaacugauccauagaacgaauaucuaaucucaauuuguccauuacaguaaugaauagggacacaauaucagcaauacaucuacuaguauuucccuuaucaucuuuaauaguaauaggucugucuuccuuaauucuuucuagggc

SEQ ID NO: 1020 - RNA, 351 nt, artificial sequence
  synthetic construct
gagggacacaauaucagcaauacaucuacuaguauuucccuuaucaucuuuaauaguaauaggucugucuuccuuaauucuuucuagggcagccgggcaaucaagccuauauuucuuaacgaaagcaucaacaguaggaaacucaucuccauuaacuugucuaaaugcugcuuuguauugaacuaguagcuuacuacaagcaccaguauacucuuuggcaacaacacaaucccuaauguaugccuuuucaagcuguugcaauguguugauaacugcguagagaucugcuaaauuaucguauuuuucccuuucccuugcauugugauacaguuuuacuucuucguaaagcuc

SEQ ID NO: 1021 - RNA, 351 nt, artificial sequence
  synthetic construct
gcucucaagaucaaaaaguaguugucuaaucugugauucugacaauucaucugauacuugcaucguauuuaauguagccaaccauucugaaaucuuuuguuugcccucaaaauccgacggcaaaaugcucaaucuguucaugguaucgacuaaaucucucacaucaggguguaacugauccauagaacgaauaucuaaucucaauuuguccauuacaguaaugaauagggacacaauaucagcaauacaucuacuaguauuucccuuaucaucuuuaauaguaauaggucugucuuccuuaauucuuucuagggcagccgggcaaucaagccuauauuucuuaacgaaagc

SEQ ID NO: 1022 - RNA, 352 nt, artificial sequence
  synthetic construct
guucaucugauacuugcaucguauuuaauguagccaaccauucugaaaucuuuuguuugcccucaaaauccgacggcaaaaugcucaaucuguucaugguaucgacuaaaucucucacaucaggguguaacugauccauagaacgaauaucuaaucucaauuuguccauuacaguaaugaauagggacacaauaucagcaauacaucuacuaguauuucccuuaucaucuuuaauaguaauaggucugucuuccuuaauucuuucuagggcagccgggcaaucaagccuauauuucuuaacgaaagcaucaacaguaggaaacucaucuccauuaacuugucuaaaugcugc

SEQ ID NO: 1023 - RNA, 351 nt, artificial sequence
  synthetic construct
guauuuaauguagccaaccauucugaaaucuuuuguuugcccucaaaauccgacggcaaaaugcucaaucuguucaugguaucgacuaaaucucucacaucaggguguaacugauccauagaacgaauaucuaaucucaauuuguccauuacaguaaugaauagggacacaauaucagcaauacaucuacuaguauuucccuuaucaucuuuaauaguaauaggucugucuuccuuaauucuuucuagggcagccgggcaaucaagccuauauuucuuaacgaaagcaucaacaguaggaaacucaucuccauuaacuugucuaaaugcugcuuuguauugaacuaguagc

SEQ ID NO: 1024 - RNA, 248 nt, artificial sequence
  synthetic construct
gaacucgauaaccaguuucucccucaauuugucaucgaugguggauacugacaauggggaggguucguuggccaggaacgugccguagucggugccuuguaaaugcagcuucaaaucuuccaggguuucgcauugcacuaaauugagguaaucggacugcuucaauaugccgcauuugaaaccgcggcauaaaccuuccaaguaaccguugucgauguuaaacagacaccccuucaugaucgaaaauc

SEQ ID NO: 1025 - RNA, 252 nt, artificial sequence
  synthetic construct
ggcccugugcuucugagccacgcacucugcgauccaaacgauguuccugcacuccugcuccuucagcuucaaauaggaauagaacacaccaaaguggaacugcugcaugaacgcguugauguucagacgcacuucgugcucgaagaauuuguccuccaacgucuuaucucccggauuguuuccagcccccucgaacaauuuggaauacucagcguaauacucggccacagccuuaaccugcucguaauccuc

SEQ ID NO: 1026 - RNA, 256 nt, artificial sequence
  synthetic construct
gaauuauguugucgaucauguagcuguaggugaugaaguccaggaauguggacagggguucuacggcuugguuacgcauaugcuggaacucgauaaccaguuucucccucaauuugucaucgaugguggauacugacaauggggaggguucguuggccaggaacgugccguagucggugccuuguaaaugcagcuucaaaucuuccaggguuucgcauugcacuaaauugagguaaucggacugcuucaauaugcc

SEQ ID NO: 1027 - RNA, 262 nt, artificial sequence
  synthetic construct
gauuucgauguucaucucguccaaauccugcucgcugaugcagucgacgaagaacggagcuagcggggugucuacuaacacggcguuguacaauuccgccgggguggccgcuacguggauggcuuccauuugcucgaagcugccgaggggguggcauuuuggaaucaacucaccgauaggucuuugaugcaaaguuccggugauuagaagaauuauguugucgaucauguagcuguaggugaugaaguccaggaauguggac

SEQ ID NO: 1028 - RNA, 252 nt, artificial sequence
  synthetic construct
gaauaucggaauguaguuaucgauuuuggcccugugcuucugagccacgcacucugcgauccaaacgauguuccugcacuccugcuccuucagcuucaaauaggaauagaacacaccaaaguggaacugcugcaugaacgcguugauguucagacgcacuucgugcucgaagaauuuguccuccaacgucuuaucucccggauuguuuccagcccccucgaacaauuuggaauacucagcguaauacucggc

SEQ ID NO: 1029 - RNA, 249 nt, artificial sequence
  synthetic construct
gaauaucggaauguaguuaucgauuuuggcccugugcuucugagccacgcacucugcgauccaaacgauguuccugcacuccugcuccuucagcuucaaauaggaauagaacacaccaaaguggaacugcugcaugaacgcguugauguucagacgcacuucgugcucgaagaauuuguccuccaacgucuuaucucccggauuguuuccagcccccucgaacaauuuggaauacucagcguaauacuc

SEQ ID NO: 1030 - RNA, 351 nt, artificial sequence
  synthetic construct
gcguccacuuccggcguuaaaugcaccgucgacucguaaaaguguuucaauuuuucaccgugcuugcuuacuaucauuaacguauugucuuuuucccaauagaugaccacggcuucguuaccgcaccauaacauuuguuucgguuugaaaacaaaaucgcaaucgauuucgcaauauuucguucucagaucugucgaacccaaccacaaaaaaccggaauccguguaaaaagccaaaugucuagcguuuaaagacaccgacauuuugauuauagauguguauuuguucguuauauccgguuccagcauugaacugguucgaucuucguccuguuucaaccuguacaauucc

SEQ ID NO: 1031 - RNA, 352 nt, artificial sequence
  synthetic construct
gauuuuccaccucgcgccuccggcagcguauccuccaauucccuuuggaaccugcacaagcgcagguguuccuccacgaugguggcguugaggucuuugcgggauuuuuuguacgccuccaaggccgacgacaaaagggcgucuuucgcgugguuuuucuuaacauccagcgagucuuugaugaaaaguucggcuugagcgcaaaaaucgucuucuugaauguaaauuucgcuuagagccugcgcguugugcucuuuacaguauuuuaugaacagcgauugagcgauagggaaauuucugauggucaucuuaaaguccccuaaaggcauguuuucucucaauuucaauaugc

SEQ ID NO: 1032 - RNA, 351 nt, artificial sequence
  synthetic construct
gagcguauccuccaauucccuuuggaaccugcacaagcgcagguguuccuccacgaugguggcguugaggucuuugcgggauuuuuuguacgccuccaaggccgacgacaaaagggcgucuuucgcgugguuuuucuuaacauccagcgagucuuugaugaaaaguucggcuugagcgcaaaaaucgucuucuugaauguaaauuucgcuuagagccugcgcguugugcucuuuacaguauuuuaugaacagcgauugagcgauagggaaauuucugauggucaucuuaaaguccccuaaaggcauguuuucucucaauuucaauaugacaguauaaacuaaauccguauc

SEQ ID NO: 1033 - RNA, 352 nt, artificial sequence
  synthetic construct
guuuucuccaucaaucgucgucgauuuucgucggaaaaucgauuucccugacauuuucccugaacguacaacaaacuuuggacgucccuuuguugauaggcuauuucggcugcuuccucuaaacgucccgcuuugauguaauauuugacuuugacauccucgccaacuuuguguaaauauuucaacgccuccugcgguuuaucgugcgccaaacaaacgucgacgaagggaugguagccgaucggggauuuuuuccauuuggagaacuucuccaauucgauccaaucguuucgaucggccaaacuggcgauuuucgcccaccaauaucuuuuaucgggaauuuugaaaucgc

SEQ ID NO: 1034 - RNA, 352 nt, artificial sequence
  synthetic construct
gucuugaauguaaauuucgcuuagagccugcgcguugugcucuuuacaguauuuuaugaacagcgauugagcgauagggaaauuucugauggucaucuuaaaguccccuaaaggcauguuuucucucaauuucaauaugacaguauaaacuaaauccguaucgccgcuuucgauggcuuugaccaaagccggcacguuuucgcccaauuccaauaguaauuucacuugaucgcucgccuucgauucguaaucuaaaagcuugauggccaacuuuuuccugccgcacuccgacgccgucgccgcuauuucgcuaaaacucaccccgccgccgcuacccuuuucgcccaauuuc

SEQ ID NO: 1035 - RNA, 352 nt, artificial sequence
  synthetic construct
gacaacaaacuuuggacgucccuuuguugauaggcuauuucggcugcuuccucuaaacgucccgcuuugauguaauauuugacuuugacauccucgccaacuuuguguaaauauuucaacgccuccugcgguuuaucgugcgccaaacaaacgucgacgaagggaugguagccgaucggggauuuuuuccauuuggagaacuucuccaauucgauccaaucguuucgaucggccaaacuggcgauuuucgcccaccaauaucuuuuaucgggaauuuugaaaucguugcgaaacuuuucggccaauuugguuucguucaauuccaauaguaauuuacacgugucuuguacgc

SEQ ID NO: 1036 - RNA, 352 nt, artificial sequence
  synthetic construct
gagucgauucugggcaacgugcagaccaaguacaaggacauaacgggcaaggaggugcaccugaagaucgacgacgagucgcacuugucgcaggagacuacgggggggaucgauuugcuggcguugaagaacaaagugaagaucaacaacacgcuggaggcgcgauuggacuugaucucgcagcaauuggugccucaaauccguaacgcucuguucgggcguaacgugaacaggaaauucaccgauuagguugcuugggguuugugcgaucguauaauauuuacaucggucgaaauaaaauaguauucgauuuauaaaauuuauuguaauguuaucaucagaugauguuguc

SEQ ID NO: 1037 - RNA, 350 nt, artificial sequence
  synthetic construct
gaauacuacgagaagaaagagaaacaagucgaacuccagaagaaaauccaaucguccaacaugcugaaccaggccagacugaagguguugaaagugagagaggaccacguucgguccgugcuggaagacgcccgcaaacgacucggcgaagucaccaaagaccaagggaaguacggccacaucaucgaaagccucauccuccaaggacucuaccagcuguucgagaaagaaguaacggugcgcgugcgcccgcaggacagggagcuggucaagucgauucugggcaacgugcagaccaaguacaaggacauaacgggcaaggaggugcaccugaagaucgacgacgaguc

SEQ ID NO: 1038 - RNA, 352 nt, artificial sequence
  synthetic construct
gaagucgauucugggcaacgugcagaccaaguacaaggacauaacgggcaaggaggugcaccugaagaucgacgacgagucgcacuugucgcaggagacuacgggggggaucgauuugcuggcguugaagaacaaagugaagaucaacaacacgcuggaggcgcgauuggacuugaucucgcagcaauuggugccucaaauccguaacgcucuguucgggcguaacgugaacaggaaauucaccgauuagguugcuugggguuugugcgaucguauaauauuuacaucggucgaaauaaaauaguauucgauuuauaaaauuuauuguaauguuaucaucagaugauguugc

SEQ ID NO: 1039 - RNA, 351 nt, artificial sequence
  synthetic construct
gagaauguugcucaucgaaucccugaucaccguccacgugaucuuguucucagauugagcggucgacucuacggcgugucucgccauaucguacaucccaaucauguucuucaacauacccacgguuuuguagaagggacagaaucugucguacgaugaguacgaguucuguugcaggaaaucuucuuucaacagcuuggcgauuuccaauguaauuuuaucagcuucggccaaugaagcuuuuccuaccagcugcacgauuucuguaagaucgucuucuucuugaagaauuuccuuaacuuugguucugagcgguaugaauuccgcaaaguuuuugucauagaaaucauc

SEQ ID NO: 1040 - RNA, 351 nt, artificial sequence
  synthetic construct
gacgugaucuuguucucagauugagcggucgacucuacggcgugucucgccauaucguacaucccaaucauguucuucaacauacccacgguuuuguagaagggacagaaucugucguacgaugaguacgaguucuguugcaggaaaucuucuuucaacagcuuggcgauuuccaauguaauuuuaucagcuucggccaaugaagcuuuuccuaccagcugcacgauuucuguaagaucgucuucuucuugaagaauuuccuuaacuuugguucugagcgguaugaauuccgcaaaguuuuugucauagaaaucaucuaaggcucucagguauuuagaguaagaacugagc

SEQ ID NO: 1041 - RNA, 351 nt, artificial sequence
  synthetic construct
gucgaaauccgccuugaucuucgccucgccgucuuucaccggauccuugaacuucauacugcucaauugguacagaauguugcucaucgaaucccugaucaccguccacgugaucuuguucucagauugagcggucgacucuacggcgugucucgccauaucguacaucccaaucauguucuucaacauacccacgguuuuguagaagggacagaaucugucguacgaugaguacgaguucuguugcaggaaaucuucuuucaacagcuuggcgauuuccaauguaauuuuaucagcuucggccaaugaagcuuuuccuaccagcugcacgauuucuguaagaucgucuuc

SEQ ID NO: 1042 - RNA, 351 nt, artificial sequence
  synthetic construct
gcgugaucuuguucucagauugagcggucgacucuacggcgugucucgccauaucguacaucccaaucauguucuucaacauacccacgguuuuguagaagggacagaaucugucguacgaugaguacgaguucuguugcaggaaaucuucuuucaacagcuuggcgauuuccaauguaauuuuaucagcuucggccaaugaagcuuuuccuaccagcugcacgauuucuguaagaucgucuucuucuugaagaauuuccuuaacuuugguucugagcgguaugaauuccgcaaaguuuuugucauagaaaucaucuaaggcucucagguauuuagaguaagaacugagcc

SEQ ID NO: 1043 - RNA, 352 nt, artificial sequence
  synthetic construct
guuuccaauguaauuuuaucagcuucggccaaugaagcuuuuccuaccagcugcacgauuucuguaagaucgucuucuucuugaagaauuuccuuaacuuugguucugagcgguaugaauuccgcaaaguuuuugucauagaaaucaucuaaggcucucagguauuuagaguaagaacugagccagucgacagacgggaaaugcuuacgcugggcgaguuucuuauccaacccccaaaacacuugcacgauaccgagaguagcagaagugacgggaucagagaaaucaccaccaggcggcgacacugcuccuacgaucgaaacagagccuucccuaucgggguuacccaagc

SEQ ID NO: 1044 - RNA, 351 nt, artificial sequence
  synthetic construct
gacggauagcgguuuuccugaucucaacacgggaucaccgacaguuacaccggaaguuucuucguagaccugaauaguugccauaucuccuuccaaacggauaauuucaccgacuaauucgaaguagcccacacguaccaauucguacauagcagauccggacaucuuuucugcugugacgacuggaccagauacagcauggacguacccauacuggcucucuuuuucuucgucuccaacacguacuuucgacauuuuuguggauguucugaaaacgagggcgauuagacgugauguuucuaauucaaccucacccacugaacuaucaaguacagcaaaucgacgauuuuc

SEQ ID NO: 1045 - RNA, 352 nt, artificial sequence
  synthetic construct
guaauuuuaucagcuucggccaaugaagcuuuuccuaccagcugcacgauuucuguaagaucgucuucuucuugaagaauuuccuuaacuuugguucugagcgguaugaauuccgcaaaguuuuugucauagaaaucaucuaaggcucucagguauuuagaguaagaacugagccagucgacagacgggaaaugcuuacgcugggcgaguuucuuauccaacccccaaaacacuugcacgauaccgagaguagcagaagugacgggaucagagaaaucaccaccaggcggcgacacugcuccuacgaucgaaacagagccuucccuaucgggguuacccaagcacuuaacgc

SEQ ID NO: 1046 - RNA, 351 nt, artificial sequence
  synthetic construct
gcaaucacuuaacaagucgucaucuauauugauauccguuguaucuauauuuucaucaauguucacuccaucaagauccaaauccaaaucguccucaucagcuucuucauuaucaacagaggguuuguucguuuguucaaccgguguuucgccgagcaaauuaucgaaauaacuugcaccugaauuuuugacuuucgcuugaaccuccgcuaucauauuucugucgugauucgguguaacggugacagccgaagcggcaggaaugaaacccgguucguuuuguuccaaauauuucugcgccgcuauggccucuugcagcccuggaaacagauuuucguaauccuugggauc

SEQ ID NO: 1047 - RNA, 350 nt, artificial sequence
  synthetic construct
ggccgugacguucuguccgugccccucuaacguuuguacgcacguuuuguucugguaaucccagauuuuaaccagccugucgucggcgcccgauauuagguaggguuuaucgccaccgugauaguaaucgacgcaauuaacgcccuuuucgugacccuccaacgugaaauuagcaguagaggcgccuaacugccaaacuuuuauuguucgguccaaagaagcgcuggcgaacguauuguugucuuugggguugauggaaauuugcaugauguaaugcacgugcccuucgaacacuuguuggcacgcccacgcuuuuucccaguuccacagcuuuaucagcauaucaucgc

SEQ ID NO: 1048 - RNA, 351 nt, artificial sequence
  synthetic construct
gaauguauuccccgucuccacaaacgaccacaaaucuaccauucggauugugcugaauaguuugcggguagauaucacaagcgcccauaucuuugauagaaaccggcaagcguucaccgucucuuauuucagcaccuucgggcaacgcuuuaagauuagcuugcuguaguuccgaaugucuggcccagaugauuuuaccgccgcuggcguccauacucacagcggguucuucucuaccgacuuuaaccagaaugcuacccucgucguaacccagcgccacguuauuggaaccuuucagacaaaaaaugguccauacucuuucgaaaccguaguucaaacugcucucuaauc

SEQ ID NO: 1049 - RNA, 351 nt, artificial sequence
  synthetic construct
guaaucgacgcaauuaacgcccuuuucgugacccuccaacgugaaauuagcaguagaggcgccuaacugccaaacuuuuauuguucgguccaaagaagcgcuggcgaacguauuguugucuuugggguugauggaaauuugcaugauguaaugcacgugcccuucgaacacuuguuggcacgcccacgcuuuuucccaguuccacagcuuuaucagcauaucaucgcuacuggucaguauguaagguugugugggaugaacaacaauggaucgcacguaaucagagugagcuucgaaagcgugcacgcgaucuagaguguuguaauugaaaacucugauuugcaugucauc

SEQ ID NO: 1050 - RNA, 351 nt, artificial sequence
  synthetic construct
guggaaccggauucucugauggcguauucgcuggaauccugcgcccaaacgaauucuugcgcgcuuccgaaagcuuuauuucugagcgccauggcgguguaaauaauguauuccccgucuccacaaacgaccacaaaucuaccauucggauugugcugaauaguuugcggguagauaucacaagcgcccauaucuuugauagaaaccggcaagcguucaccgucucuuauuucagcaccuucgggcaacgcuuuaagauuagcuugcuguaguuccgaaugucuggcccagaugauuuuaccgccgcuggcguccauacucacagcggguucuucucuaccgacuuuaacc

SEQ ID NO: 1051 - RNA, 351 nt, artificial sequence
  synthetic construct
guauaaaauaacuaucuucgguggcuaaacacaccaauuugccgcuguccgaccaguagaucgaacggggcuguauuucgauucuucugaccaaauccaacguuucccagucguagaaagccaaucccgagacggauuuuacccccaaaagauaaccgccguauauaccuucggcuccgaagucggauuugaaauucuuuuuuucuuugaaauuuuugaauauucuuauaguggaaccggauucucugauggcguauucgcuggaauccugcgcccaaacgaauucuugcgcgcuuccgaaagcuuuauuucugagcgccauggcgguguaaauaauguauuccccgucuc

SEQ ID NO: 1052 - RNA, 351 nt, artificial sequence
  synthetic construct
gauuuuaucgggaagauaagaucucgcgaaaaacgccgcuucgggaagccuaccggugcuuaucaaaauguccagacauuuguucaagucaccgacuaauaagugggacaagaaugccaaguuaugcuugcccucggcuuccguggcuucgccuaauguccucacuaccucgucaucuccagaacugguagcuaagagcaacaauccaccguaaucuugggcuuucugcaugcacucuuuggccaacacgagauuauucguggaggccgccaaaucggccaguuggcuccauuucugcggguuguuagccuccugggccaacauuuuggccguauucaaauccuccaaagc

SEQ ID NO: 1053 - RNA, 352 nt, artificial sequence
  synthetic construct
gugacagccgaagcggcaggaaugaaacccgguucguuuuguuccaaauauuucugcgccgcuauggccucuugcagcccuggaaacagauuuucguaauccuugggaucggccaaacuuuggccggcuuucugauugacagucgacaauugggcccuccaaagguccaccaccuccgaaauuuuaucgggaagauaagaucucgcgaaaaacgccgcuucgggaagccuaccggugcuuaucaaaauguccagacauuuguucaagucaccgacuaauaagugggacaagaaugccaaguuaugcuugcccucggcuuccguggcuucgccuaauguccucacuaccucgc

SEQ ID NO: 1054 - RNA, 350 nt, artificial sequence
  synthetic construct
ggaaaguggaaagagaagccaagauggauccaccgauccauacggaguauuuccuuucugggggagcgaugaucuugauuuugaucgugcugggggccaaggcggugauuuccuuuugcauacggucagcaauaccaggguacauggugguaccaccggacaagacgguguuggcguacaaguccuuacggauaucgacgucacacuucaugauggaguuguagacgguuucguggauaccgcaggauuccauacccaagaaggaagguuggaauagagccucaggacaacggaaucucucguuaccgauggugaugacuugaccgucggguaauucguagcucuuuucc

SEQ ID NO: 1055 - RNA, 352 nt, artificial sequence
  synthetic construct
guggcuuuaggguuaagaggagcuucggucaaaagaacgggguguucuuccggagccacacggaguucguuguagaagguguggugccagaucuuuuccauaucaucccaguuggugaugauaccguguucgaugggguauuucaaagugaggauaccucuuuugcuuugggcuucgucaccuacguaggaaucuuuuugacccauaccgaccaugacuccuugaugucuugggcgaccgacgauggagggaaagacggcgcgcggagcgucgucuccggcgaaaccggccuugcacauaccggagccauugucuacgacuaaagcggcgacuucuucuucacacauuuugc

SEQ ID NO: 1056 - RNA, 351 nt, artificial sequence
  synthetic construct
ggaaagagaagccaagauggauccaccgauccauacggaguauuuccuuucugggggagcgaugaucuugauuuugaucgugcugggggccaaggcggugauuuccuuuugcauacggucagcaauaccaggguacauggugguaccaccggacaagacgguguuggcguacaaguccuuacggauaucgacgucacacuucaugauggaguuguagacgguuucguggauaccgcaggauuccauacccaagaaggaagguuggaauagagccucaggacaacggaaucucucguuaccgauggugaugacuugaccgucggguaauucguagcucuuuuccaaugaggc

SEQ ID NO: 1057 - RNA, 352 nt, artificial sequence
  synthetic construct
guuacggauaucgacgucacacuucaugauggaguuguagacgguuucguggauaccgcaggauuccauacccaagaaggaagguuggaauagagccucaggacaacggaaucucucguuaccgauggugaugacuugaccgucggguaauucguagcucuuuuccaaugagguggaagcggcggcgguggccauuuccuguucgaaguccaaugcgacauagcagaguuuuuccuugaugucacggacgauuucucuuucagcggugguggugaaugaguaaccucuuucggugaggauuuucaugagguagucggucaaaucgcgaccggccaaguccaaacggaggauc

SEQ ID NO: 1058 - RNA, 352 nt, artificial sequence
  synthetic construct
guucaaacaugauuugagucaucuuuucccuguuggcuuuaggguuaagaggagcuucggucaaaagaacgggguguucuuccggagccacacggaguucguuguagaagguguggugccagaucuuuuccauaucaucccaguuggugaugauaccguguucgaugggguauuucaaagugaggauaccucuuuugcuuugggcuucgucaccuacguaggaaucuuuuugacccauaccgaccaugacuccuugaugucuugggcgaccgacgauggagggaaagacggcgcgcggagcgucgucuccggcgaaaccggccuugcacauaccggagccauugucuacgac

SEQ ID NO: 1059 - RNA, 352 nt, artificial sequence
  synthetic construct
guuucaaacaugauuugagucaucuuuucccuguuggcuuuaggguuaagaggagcuucggucaaaagaacgggguguucuuccggagccacacggaguucguuguagaagguguggugccagaucuuuuccauaucaucccaguuggugaugauaccguguucgaugggguauuucaaagugaggauaccucuuuugcuuugggcuucgucaccuacguaggaaucuuuuugacccauaccgaccaugacuccuugaugucuugggcgaccgacgauggagggaaagacggcgcgcggagcgucgucuccggcgaaaccggccuugcacauaccggagccauugucuacgc

SEQ ID NO: 1060 - RNA, 351 nt, artificial sequence
  synthetic construct
guagaagcacuugcggugaacgauuccagggccggauucgucguauuccuguuuggagauccacaucuguuggaaaguggaaagagaagccaagauggauccaccgauccauacggaguauuuccuuucugggggagcgaugaucuugauuuugaucgugcugggggccaaggcggugauuuccuuuugcauacggucagcaauaccaggguacauggugguaccaccggacaagacgguguuggcguacaaguccuuacggauaucgacgucacacuucaugauggaguuguagacgguuucguggauaccgcaggauuccauacccaagaaggaagguuggaauagagc

SEQ ID NO: 1061 - RNA, 352 nt, artificial sequence
  synthetic construct
gugauuugagucaucuuuucccuguuggcuuuaggguuaagaggagcuucggucaaaagaacgggguguucuuccggagccacacggaguucguuguagaagguguggugccagaucuuuuccauaucaucccaguuggugaugauaccguguucgaugggguauuucaaagugaggauaccucuuuugcuuugggcuucgucaccuacguaggaaucuuuuugacccauaccgaccaugacuccuugaugucuugggcgaccgacgauggagggaaagacggcgcgcggagcgucgucuccggcgaaaccggccuugcacauaccggagccauugucuacgacuaaagcgc

SEQ ID NO: 1062 - RNA, 350 nt, artificial sequence
  synthetic construct
gggugacaccgucaccggaguccaaaacgauaccggugguacgaccggaagcguacaaggaaaguacggcuuggauggcgacguacauagcggggguguugaagguuucaaacaugauuugagucaucuuuucccuguuggcuuuaggguuaagaggagcuucggucaaaagaacgggguguucuuccggagccacacggaguucguuguagaagguguggugccagaucuuuuccauaucaucccaguuggugaugauaccguguucgaugggguauuucaaagugaggauaccucuuuugcuuugggcuucgucaccuacguaggaaucuuuuugacccauaccgacc

SEQ ID NO: 1063 - RNA, 350 nt, artificial sequence
  synthetic construct
gcgugaggcaaagcguaaccuucguagauggguacggugugggugacaccgucaccggaguccaaaacgauaccggugguacgaccggaagcguacaaggaaaguacggcuuggauggcgacguacauagcggggguguugaagguuucaaacaugauuugagucaucuuuucccuguuggcuuuaggguuaagaggagcuucggucaaaagaacgggguguucuuccggagccacacggaguucguuguagaagguguggugccagaucuuuuccauaucaucccaguuggugaugauaccguguucgaugggguauuucaaagugaggauaccucuuuugcuuugggc

SEQ ID NO: 1064 - RNA, 351 nt, artificial sequence
  synthetic construct
guucuggagggccucagcggcguuccucauggagucuaagacggcuguguuggugcuggcuccuuccaaggccucucuuugcauuucgaucgucguaagaguuccaucuauuuguaguugcguuuuuuccaaucguuucuucuuuuugagcgcuugaagcgccacucuuuuguucuucgaugcauucuuuuuggcuacuaaaguguauuccucuauuuucuuuucuaaaaacucuuguuuuuuauauaacauguccucgguuucccugagcuuuuggauggccuccccgggcguagggcccucgucuuuuuccuuuccuccgaauauuuuacuaaagaaacucauuuuucc

SEQ ID NO: 1065 - RNA, 352 nt, artificial sequence
  synthetic construct
guaaucucauuggcaauaucguguuguucagcuaugucguccaugauaucguggacaucaucgacguucaaguuuuugugggccuucuggagggccucagcggcguuccucauggagucuaagacggcuguguuggugcuggcuccuuccaaggccucucuuugcauuucgaucgucguaagaguuccaucuauuuguaguugcguuuuuuccaaucguuucuucuuuuugagcgcuugaagcgccacucuuuuguucuucgaugcauucuuuuuggcuacuaaaguguauuccucuauuuucuuuucuaaaaacucuuguuuuuuauauaacauguccucgguuucccugc

SEQ ID NO: 1066 - RNA, 351 nt, artificial sequence
  synthetic construct
gcguuccucauggagucuaagacggcuguguuggugcuggcuccuuccaaggccucucuuugcauuucgaucgucguaagaguuccaucuauuuguaguugcguuuuuuccaaucguuucuucuuuuugagcgcuugaagcgccacucuuuuguucuucgaugcauucuuuuuggcuacuaaaguguauuccucuauuuucuuuucuaaaaacucuuguuuuuuauauaacauguccucgguuucccugagcuuuuggauggccuccccgggcguagggcccucgucuuuuuccuuuccuccgaauauuuuacuaaagaaacucauuuuuccaauggaaauaagggaaaac

SEQ ID NO: 1067 - RNA, 352 nt, artificial sequence
  synthetic construct
guuucaguaaaucuuccucuaauccuucuuguuccaguuucuccaguucgcuuuccaauucguccucguccaaaucgucggcgaagcccacagguugacuaauagcaguuguaaucucauuggcaauaucguguuguucagcuaugucguccaugauaucguggacaucaucgacguucaaguuuuugugggccuucuggagggccucagcggcguuccucauggagucuaagacggcuguguuggugcuggcuccuuccaaggccucucuuugcauuucgaucgucguaagaguuccaucuauuuguaguugcguuuuuuccaaucguuucuucuuuuugagcgcuugaac

SEQ ID NO: 1068 - RNA, 351 nt, artificial sequence
  synthetic construct
guaauagcaguuguaaucucauuggcaauaucguguuguucagcuaugucguccaugauaucguggacaucaucgacguucaaguuuuugugggccuucuggagggccucagcggcguuccucauggagucuaagacggcuguguuggugcuggcuccuuccaaggccucucuuugcauuucgaucgucguaagaguuccaucuauuuguaguugcguuuuuuccaaucguuucuucuuuuugagcgcuugaagcgccacucuuuuguucuucgaugcauucuuuuuggcuacuaaaguguauuccucuauuuucuuuucuaaaaacucuuguuuuuuauauaacaugucc

SEQ ID NO: 1069 - RNA, 352 nt, artificial sequence
  synthetic construct
guaaaucuuccucuaauccuucuuguuccaguuucuccaguucgcuuuccaauucguccucguccaaaucgucggcgaagcccacagguugacuaauagcaguuguaaucucauuggcaauaucguguuguucagcuaugucguccaugauaucguggacaucaucgacguucaaguuuuugugggccuucuggagggccucagcggcguuccucauggagucuaagacggcuguguuggugcuggcuccuuccaaggccucucuuugcauuucgaucgucguaagaguuccaucuauuuguaguugcguuuuuuccaaucguuucuucuuuuugagcgcuugaagcgccac

SEQ ID NO: 1070 - RNA, 352 nt, artificial sequence
  synthetic construct
gagcaguuguaaucucauuggcaauaucguguuguucagcuaugucguccaugauaucguggacaucaucgacguucaaguuuuugugggccuucuggagggccucagcggcguuccucauggagucuaagacggcuguguuggugcuggcuccuuccaaggccucucuuugcauuucgaucgucguaagaguuccaucuauuuguaguugcguuuuuuccaaucguuucuucuuuuugagcgcuugaagcgccacucuuuuguucuucgaugcauucuuuuuggcuacuaaaguguauuccucuauuuucuuuucuaaaaacucuuguuuuuuauauaacauguccucggc

SEQ ID NO: 1071 - RNA, 351 nt, artificial sequence
  synthetic construct
guacgaagcccaagccuccaauuccuucaugucaucaucauccuccacuuuuuuagcagcagguuuaaccgguuuagcgauagcccccguagguacagcggguaauucaguaggacccggaacuuucaguaaaucuuccucuaauccuucuuguuccaguuucuccaguucgcuuuccaauucguccucguccaaaucgucggcgaagcccacagguugacuaauagcaguuguaaucucauuggcaauaucguguuguucagcuaugucguccaugauaucguggacaucaucgacguucaaguuuuugugggccuucuggagggccucagcggcguuccucauggaguc

SEQ ID NO: 1072 - RNA, 351 nt, artificial sequence
  synthetic construct
gcguauccuccaauucccuuuggaaccugcacaagcgcagguguuccuccacgaugguggcguugaggucuuugcgggauuuuuuguacgccuccaaggccgacgacaaaagggcgucuuucgcgugguuuuucuuaacauccagcgagucuuugaugaaaaguucggcuugagcgcaaaaaucgucuucuugaauguaaauuucgcuuagagccugcgcguugugcucuuuacaguauuuuaugaacagcgauugagcgauagggaaauuucugauggucaucuuaaaguccccuaaaggcauguuuucucucaauuucaauaugacaguauaaacuaaauccguaucgc

SEQ ID NO: 1073 - RNA, 351 nt, artificial sequence
  synthetic construct
gaaaguucggcuugagcgcaaaaaucgucuucuugaauguaaauuucgcuuagagccugcgcguugugcucuuuacaguauuuuaugaacagcgauugagcgauagggaaauuucugauggucaucuuaaaguccccuaaaggcauguuuucucucaauuucaauaugacaguauaaacuaaauccguaucgccgcuuucgauggcuuugaccaaagccggcacguuuucgcccaauuccaauaguaauuucacuugaucgcucgccuucgauucguaaucuaaaagcuugauggccaacuuuuuccugccgcacuccgacgccgucgccgcuauuucgcuaaaacucacc

SEQ ID NO: 1074 - RNA, 351 nt, artificial sequence
  synthetic construct
guuaugaacagcgauugagcgauagggaaauuucugauggucaucuuaaaguccccuaaaggcauguuuucucucaauuucaauaugacaguauaaacuaaauccguaucgccgcuuucgauggcuuugaccaaagccggcacguuuucgcccaauuccaauaguaauuucacuugaucgcucgccuucgauucguaaucuaaaagcuugauggccaacuuuuuccugccgcacuccgacgccgucgccgcuauuucgcuaaaacucaccccgccgccgcuacccuuuucgcccaauuuggcggcuaucucucuggcgaccgucuccucgucgagucgacuuugaccgacc

SEQ ID NO: 1075 - RNA, 352 nt, artificial sequence
  synthetic construct
guugcuuacuaucauuaacguauugucuuuuucccaauagaugaccacggcuucguuaccgcaccauaacauuuguuucgguuugaaaacaaaaucgcaaucgauuucgcaauauuucguucucagaucugucgaacccaaccacaaaaaaccggaauccguguaaaaagccaaaugucuagcguuuaaagacaccgacauuuugauuauagauguguauuuguucguuauauccgguuccagcauugaacugguucgaucuucguccuguuucaaccuguacaauuccaagcuucuagccaccaaaaucuccguccuauugucaucagaaacaaucgcccaaccaguaggc

SEQ ID NO: 1076 - RNA, 352 nt, artificial sequence
  synthetic construct
gcaacaaacuuuggacgucccuuuguugauaggcuauuucggcugcuuccucuaaacgucccgcuuugauguaauauuugacuuugacauccucgccaacuuuguguaaauauuucaacgccuccugcgguuuaucgugcgccaaacaaacgucgacgaagggaugguagccgaucggggauuuuuuccauuuggagaacuucuccaauucgauccaaucguuucgaucggccaaacuggcgauuuucgcccaccaauaucuuuuaucgggaauuuugaaaucguugcgaaacuuuucggccaauuugguuucguucaauuccaauaguaauuuacacgugucuuguacggc

SEQ ID NO: 1077 - RNA, 352 nt, artificial sequence
  synthetic construct
gaaggcgaugcguuguuguguauagaagucgaugcauuuugcaagagugguuucaacauauucuguucuagcauuuacgucgaagagaucaccagcucccaaagcguacguuaacgagucuucgaacgcacccagaugguaguauacuuuacuagcgacuaaagcagcuaacugguguuguugaaacacuuugucuucgugcagaauuucuaucuuuucaauagcuucugaaauuucuggccagaauucgucgacuauggagucuaguuuucuuaacgcgaauacuuuaaguucuggucuugguucuucuaaaagggauauaauccccgcagccgaaguaauauucauccuc

SEQ ID NO: 1078 - RNA, 351 nt, artificial sequence
  synthetic construct
guaauaauuuucuaaucgccugguugugucccgugccgcaauaagccauagcuaauguauacaugccggaucuucucaggauuggauccuuaucagaaguaagcuguuguauuaggguaucagcuucuucuaaucggccguacaucgugaagcuuauaccaacagccaaaccgcgaagaaucuuuucguguugacucucuugcgcguacgcuaccauauccauaaucguaguggaauuacuggauccuaacauaaccaugcccaucgcaauuccagcggccucuccgguauuagcaucaucuugauagagauugaacuucagcuguucguagacaucuugccugugugucc

SEQ ID NO: 1079 - RNA, 351 nt, artificial sequence
  synthetic construct
gcauucgaaugguucuggugguucugguuccuuuucaucaucgcccuuuggaccgaaugcugcuacggguuccaccaauuccucuucaccagguuucaaauugcgaaccauaauaaucccuccgaucgaaacauccuucauugcaacguauugcgaguuaucauuaagcguaaucacuuucagcuguugccucaugguccuggcaggauuuugcaggauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuucuc

SEQ ID NO: 1080 - RNA, 351 nt, artificial sequence
  synthetic construct
gcugcuacggguuccaccaauuccucuucaccagguuucaaauugcgaaccauaauaaucccuccgaucgaaacauccuucauugcaacguauugcgaguuaucauuaagcguaaucacuuucagcuguugccucaugguccuggcaggauuuugcaggauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuucucuucgguuuucuucuccuucuccuccuucucgggcuucuuaucgucuuuaucuucgucc

SEQ ID NO: 1081 - RNA, 352 nt, artificial sequence
  synthetic construct
gauucgaaugguucuggugguucugguuccuuuucaucaucgcccuuuggaccgaaugcugcuacggguuccaccaauuccucuucaccagguuucaaauugcgaaccauaauaaucccuccgaucgaaacauccuucauugcaacguauugcgaguuaucauuaagcguaaucacuuucagcuguugccucaugguccuggcaggauuuugcaggauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuucucuc

SEQ ID NO: 1082 - RNA, 352 nt, artificial sequence
  synthetic construct
gugcugcuacggguuccaccaauuccucuucaccagguuucaaauugcgaaccauaauaaucccuccgaucgaaacauccuucauugcaacguauugcgaguuaucauuaagcguaaucacuuucagcuguugccucaugguccuggcaggauuuugcaggauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuucucuucgguuuucuucuccuucuccuccuucucgggcuucuuaucgucuuuaucuucguc

SEQ ID NO: 1083 - RNA, 352 nt, artificial sequence
  synthetic construct
guuaacgcguacauaccagccucggugcaaacacccuucacuucggcaccgcuagcgcccggcaucaauucggcgauuuuccucagauugauuccucuggucaaauucauuuuucuagagugaauuuucaggauguccaaucgggcuuccucguucgguggcgggaauucgauuuuccugucgauucugccgggucugagcaaagccgggucuaaaauaucgauucuguugguggccaugaugacuuuaauguuuuucgucgcuucgaauccguccaauugauugagcaacuccaacauuguucucuggacuucggaaucaccgcccgaaccugauucgauacgagaagauc

SEQ ID NO: 1084 - RNA, 352 nt, artificial sequence
  synthetic construct
guaacgaaaaguucucuaaccauccuggaaccuucuccgaugaauuuuugcaccaacuccgauccagauacacgaauaaacguacauucuguaugaugagccacugcucuggccaaaagaguuuuuccaguuccuggaggaccguauaaaagcacacccuucgguugagcgauacccaaggcaucgaaaaguucaggaugcuucacgggcaauucaaugaccucuuugauuucuuuuauuugcuuguccagaccaccgaccauuucguaaguggaauccggcacuuuuuccaccaucauaagagacacuaaaggauccaccuuauucgguaaaauuuugugcaaaguguaac

SEQ ID NO: 1085 - RNA, 352 nt, artificial sequence
  synthetic construct
gagagcaacucuacaauugggugugacaucguuaaugucgauauucuuaucgauaucgaccacaaauuuucccuccggaugaacuuugacgaggacuuucuucuuguccaucgguuuuacuacuucaccuacguagcuuccuuguucuugaagcaacaucaguucuucucuaagcauacgaacuuuggcguuaaguucguuccuuugggccugcaaucuucgaagguuuugacucuuuucggcaacgauaaguugcaauucuucgauuuucguaauguaauacgaccugaagccuucccccuucaggccuccgucgaccuccaucuuauugauaacagucaucgucgguuuc

SEQ ID NO: 1086 - RNA, 351 nt, artificial sequence
  synthetic construct
gaagagacacuaaaggauccaccuuauucgguaaaauuuugugcaaaguguaagauucauuucgaagagcaacucuacaauugggugugacaucguuaaugucgauauucuuaucgauaucgaccacaaauuuucccuccggaugaacuuugacgaggacuuucuucuuguccaucgguuuuacuacuucaccuacguagcuuccuuguucuugaagcaacaucaguucuucucuaagcauacgaacuuuggcguuaaguucguuccuuugggccugcaaucuucgaagguuuugacucuuuucggcaacgauaaguugcaauucuucgauuuucguaauguaauacgacc

SEQ ID NO: 1087 - RNA, 351 nt, artificial sequence
  synthetic construct
gucucucucuuaacgcguacauaccagccucggugcaaacacccuucacuucggcaccgcuagcgcccggcaucaauucggcgauuuuccucagauugauuccucuggucaaauucauuuuucuagagugaauuuucaggauguccaaucgggcuuccucguucgguggcgggaauucgauuuuccugucgauucugccgggucugagcaaagccgggucuaaaauaucgauucuguugguggccaugaugacuuuaauguuuuucgucgcuucgaauccguccaauugauugagcaacuccaacauuguucucuggacuucggaaucaccgcccgaaccugauucgauac

SEQ ID NO: 1088 - RNA, 352 nt, artificial sequence
  synthetic construct
gucgaagagcaacucuacaauugggugugacaucguuaaugucgauauucuuaucgauaucgaccacaaauuuucccuccggaugaacuuugacgaggacuuucuucuuguccaucgguuuuacuacuucaccuacguagcuuccuuguucuugaagcaacaucaguucuucucuaagcauacgaacuuuggcguuaaguucguuccuuugggccugcaaucuucgaagguuuugacucuuuucggcaacgauaaguugcaauucuucgauuuucguaauguaauacgaccugaagccuucccccuucaggccuccgucgaccuccaucuuauugauaacagucaucgucgc

SEQ ID NO: 1089 - RNA, 352 nt, artificial sequence
  synthetic construct
guugagcaacuccaacauuguucucuggacuucggaaucaccgcccgaaccugauucgauacgagaagauccaauagaaucgauuucguccaugaaaauuauggaaggugcguguucucuggccauaacgaaaaguucucuaaccauccuggaaccuucuccgaugaauuuuugcaccaacuccgauccagauacacgaauaaacguacauucuguaugaugagccacugcucuggccaaaagaguuuuuccaguuccuggaggaccguauaaaagcacacccuucgguugagcgauacccaaggcaucgaaaaguucaggaugcuucacgggcaauucaaugaccucuuuc

SEQ ID NO: 1090 - RNA, 351 nt, artificial sequence
  synthetic construct
gucauaagagacacuaaaggauccaccuuauucgguaaaauuuugugcaaaguguaagauucauuucgaagagcaacucuacaauugggugugacaucguuaaugucgauauucuuaucgauaucgaccacaaauuuucccuccggaugaacuuugacgaggacuuucuucuuguccaucgguuuuacuacuucaccuacguagcuuccuuguucuugaagcaacaucaguucuucucuaagcauacgaacuuuggcguuaaguucguuccuuugggccugcaaucuucgaagguuuugacucuuuucggcaacgauaaguugcaauucuucgauuuucguaauguaauac

SEQ ID NO: 1091 - RNA, 351 nt, artificial sequence
  synthetic construct
guaagagacacuaaaggauccaccuuauucgguaaaauuuugugcaaaguguaagauucauuucgaagagcaacucuacaauugggugugacaucguuaaugucgauauucuuaucgauaucgaccacaaauuuucccuccggaugaacuuugacgaggacuuucuucuuguccaucgguuuuacuacuucaccuacguagcuuccuuguucuugaagcaacaucaguucuucucuaagcauacgaacuuuggcguuaaguucguuccuuugggccugcaaucuucgaagguuuugacucuuuucggcaacgauaaguugcaauucuucgauuuucguaauguaauacgac

SEQ ID NO: 1092 - RNA, 352 nt, artificial sequence
  synthetic construct
gauuucgaagagcaacucuacaauugggugugacaucguuaaugucgauauucuuaucgauaucgaccacaaauuuucccuccggaugaacuuugacgaggacuuucuucuuguccaucgguuuuacuacuucaccuacguagcuuccuuguucuugaagcaacaucaguucuucucuaagcauacgaacuuuggcguuaaguucguuccuuugggccugcaaucuucgaagguuuugacucuuuucggcaacgauaaguugcaauucuucgauuuucguaauguaauacgaccugaagccuucccccuucaggccuccgucgaccuccaucuuauugauaacagucaucgc

SEQ ID NO: 1093 - RNA, 350 nt, artificial sequence
  synthetic construct
gcgcuauagucucuccguggaauaucaaaauuuggaaaaacguguccauaagcaguauucuaucgggcuguauggaacucguaucuaauagaacaggcuccggagggccguugaaacuguaacuguacaaaauugguugaaucaugaucaaugauugaguaagaucuucucucaucagcauaugucgauagaacgacguuucaucaggagaauuauugaaaacuugcaggaacugagaccuccuuagaugguacaugaauugcggauagaggcuaaaguuuuggcccaaucugaaugaaccagcaucgucuuuauuguauucuccgaauuuuugacacaaucgaaucagc

SEQ ID NO: 1094 - RNA, 351 nt, artificial sequence
  synthetic construct
guuuguaauaucucuugagcaucguccacgggcgcuugcaaaaguugccuaaaguuuucguauucgggcauauccugguacuucaaauuucgccauugcgcuauagucucuccguggaauaucaaaauuuggaaaaacguguccauaagcaguauucuaucgggcuguauggaacucguaucuaauagaacaggcuccggagggccguugaaacuguaacuguacaaaauugguugaaucaugaucaaugauugaguaagaucuucucucaucagcauaugucgauagaacgacguuucaucaggagaauuauugaaaacuugcaggaacugagaccuccuuagaugguac

SEQ ID NO: 1095 - RNA, 352 nt, artificial sequence
  synthetic construct
gaucagcauaugucgauagaacgacguuucaucaggagaauuauugaaaacuugcaggaacugagaccuccuuagaugguacaugaauugcggauagaggcuaaaguuuuggcccaaucugaaugaaccagcaucgucuuuauuguauucuccgaauuuuugacacaaucgaaucagcauucuaucgacccaucucagaacgucgggacuuucaucugauucagcucuauaaacagccauucuggccauaauuacagcugcugcuucuugaucaaaaccagcgcugaugugguggauauuaguaguggcgucagcccaguuucgagccacuguugucacucuaauucuucuc

SEQ ID NO: 1096 - RNA, 352 nt, artificial sequence
  synthetic construct
guacaucgucuguuaaaaccggagcgccagcguccccuccauaugaauacauguuauugugagucugacucggauugacuuuggacaauaaaaaucuagccugcgauccuccuuguucgguaucgauauaucucggcaugggaaaucucguuuguaauaucucuugagcaucguccacgggcgcuugcaaaaguugccuaaaguuuucguauucgggcauauccugguacuucaaauuucgccauugcgcuauagucucuccguggaauaucaaaauuuggaaaaacguguccauaagcaguauucuaucgggcuguauggaacucguaucuaauagaacaggcuccggagc

SEQ ID NO: 1097 - RNA, 352 nt, artificial sequence
  synthetic construct
guuaaugauacacaggauccaaugccuccuugcacuuuuaauucucgagaacauuucacuucuaauguuccguuaaaagccauuuucaaaucguuuuucugaucucugguaaacacucuuuggaacguuuguuugaacaacgaggaauugaacgagucucccaucaccauaugaccuccuguagaauugacgcauugcuucauuuccaucaaaccaguuugaucaagagcgcaggaauagaugucaauacaaugaccguuagucgccgcucucauagccagaguaucguaauguuuaauagcuuuuuucauguauuucgcguuaucuuuuuggaugucaugaugggaucuac

SEQ ID NO: 1098 - RNA, 351 nt, artificial sequence
  synthetic construct
gcuaucgggcuguauggaacucguaucuaauagaacaggcuccggagggccguugaaacuguaacuguacaaaauugguugaaucaugaucaaugauugaguaagaucuucucucaucagcauaugucgauagaacgacguuucaucaggagaauuauugaaaacuugcaggaacugagaccuccuuagaugguacaugaauugcggauagaggcuaaaguuuuggcccaaucugaaugaaccagcaucgucuuuauuguauucuccgaauuuuugacacaaucgaaucagcauucuaucgacccaucucagaacgucgggacuuucaucugauucagcucuauaaacagc

SEQ ID NO: 1099 - RNA, 352 nt, artificial sequence
  synthetic construct
guuuaaugauacacaggauccaaugccuccuugcacuuuuaauucucgagaacauuucacuucuaauguuccguuaaaagccauuuucaaaucguuuuucugaucucugguaaacacucuuuggaacguuuguuugaacaacgaggaauugaacgagucucccaucaccauaugaccuccuguagaauugacgcauugcuucauuuccaucaaaccaguuugaucaagagcgcaggaauagaugucaauacaaugaccguuagucgccgcucucauagccagaguaucguaauguuuaauagcuuuuuucauguauuucgcguuaucuuuuuggaugucaugaugggaucuc

SEQ ID NO: 1100 - RNA, 352 nt, artificial sequence
  synthetic construct
guaucucuugagcaucguccacgggcgcuugcaaaaguugccuaaaguuuucguauucgggcauauccugguacuucaaauuucgccauugcgcuauagucucuccguggaauaucaaaauuuggaaaaacguguccauaagcaguauucuaucgggcuguauggaacucguaucuaauagaacaggcuccggagggccguugaaacuguaacuguacaaaauugguugaaucaugaucaaugauugaguaagaucuucucucaucagcauaugucgauagaacgacguuucaucaggagaauuauugaaaacuugcaggaacugagaccuccuuagaugguacaugaauuc

SEQ ID NO: 1101 - RNA, 352 nt, artificial sequence
  synthetic construct
gugcgcuauagucucuccguggaauaucaaaauuuggaaaaacguguccauaagcaguauucuaucgggcuguauggaacucguaucuaauagaacaggcuccggagggccguugaaacuguaacuguacaaaauugguugaaucaugaucaaugauugaguaagaucuucucucaucagcauaugucgauagaacgacguuucaucaggagaauuauugaaaacuugcaggaacugagaccuccuuagaugguacaugaauugcggauagaggcuaaaguuuuggcccaaucugaaugaaccagcaucgucuuuauuguauucuccgaauuuuugacacaaucgaaucagc

SEQ ID NO: 1102 - RNA, 351 nt, artificial sequence
  synthetic construct
gauugcgcuauagucucuccguggaauaucaaaauuuggaaaaacguguccauaagcaguauucuaucgggcuguauggaacucguaucuaauagaacaggcuccggagggccguugaaacuguaacuguacaaaauugguugaaucaugaucaaugauugaguaagaucuucucucaucagcauaugucgauagaacgacguuucaucaggagaauuauugaaaacuugcaggaacugagaccuccuuagaugguacaugaauugcggauagaggcuaaaguuuuggcccaaucugaaugaaccagcaucgucuuuauuguauucuccgaauuuuugacacaaucgaauc

SEQ ID NO: 1103 - RNA, 352 nt, artificial sequence
  synthetic construct
guaucuaauagaacaggcuccggagggccguugaaacuguaacuguacaaaauugguugaaucaugaucaaugauugaguaagaucuucucucaucagcauaugucgauagaacgacguuucaucaggagaauuauugaaaacuugcaggaacugagaccuccuuagaugguacaugaauugcggauagaggcuaaaguuuuggcccaaucugaaugaaccagcaucgucuuuauuguauucuccgaauuuuugacacaaucgaaucagcauucuaucgacccaucucagaacgucgggacuuucaucugauucagcucuauaaacagccauucuggccauaauuacagcuc

SEQ ID NO: 1104 - RNA, 351 nt, artificial sequence
  synthetic construct
gcacuguaauucccuucgauauuuuucaaauagucuccuuccaaauggucuagcacggcuuuagguaauaaaggagguaaacuuucaguugaagcuguuagaucuggauggcccaacaugucuuuugauuuauacguuuucaaggcccaagaaaguauuguaacguauucguuaccuuugagcccguuuuguauaauuucuuguagauguacagaaagaccaccaugauacauaugaauguauuugucuaauauuuuguaacuugguggaaaacaaggaagacagaguguuuuaacaauucucaaaucuucuaagaucaucauucuaauuaguucuaaauaacguauaagc

SEQ ID NO: 1105 - RNA, 351 nt, artificial sequence
  synthetic construct
guaaaaguucaaauugauauuuacaaguuuuggaaacaacaaaguccuaaaaaucguacuuuuguguagaacuuuagguuuaucuauaugcgcaacuuugucucuaacuucagaccuugauagaucgccucucaaauuuagcaaccucaggagaugaucauccgugauaucgggauauuuuuccacgacucugugaagcucaaacgacaucauaucgucaucacuuuucaauaccuccgagagcauaaugauggcaucgaauggguuuucgcauucgaugucuuugcuaagggucugaaacaaucuguucaaucgguuggccucuuccgacgcuuuuugugcugcuuucgc

SEQ ID NO: 1106 - RNA, 351 nt, artificial sequence
  synthetic construct
guguaacuugguggaaaacaaggaagacagaguguuuuaacaauucucaaaucuucuaagaucaucauucuaauuaguucuaaauaacguauaagccaauguuuauuguccucucuuucuucaacuugaguacccucgauuuuggaugacacggucuucuccaaaauuuuaaaagccauuucucuccauuucuucggucgagcuggaggaaugaauccaguuuguuuuuguugcuuuaaagcuucuucguccgcuuuuucuucucuuucuaugauccgcaaggcuguuacgauuacugucgggucuuuucuuacuguauuuaagguucuagauaaaaugaacguuaguugc

SEQ ID NO: 1107 - RNA, 351 nt, artificial sequence
  synthetic construct
guggaaguaaucuucgaugguuacauaaauuguguccgcaggauuggaagcgaaccaaugugauguaaacaguuugucgaaauguugguccgagucgacaaauaauucuucuaagagauaauggacugccucguuucucauuuuaauauaagucgcuuuuaaugcuccaaaauuccuaguaaguucaugcgaacuguuguuaguaacauauucuuuuuccaauugagaaccuaauucaacaaguugcaggauauuguugauaauuaagaucauguauugaguaaaauauacaacuuguuuccugucuucaaaauauuuauucuugaauucgauaaucgcuucucuaaaagc

SEQ ID NO: 1108 - RNA, 351 nt, artificial sequence
  synthetic construct
gcauuccucuuuuucugauuugagaguguucugcauccauucacuguaauucccuucgauauuuuucaaauagucuccuuccaaauggucuagcacggcuuuagguaauaaaggagguaaacuuucaguugaagcuguuagaucuggauggcccaacaugucuuuugauuuauacguuuucaaggcccaagaaaguauuguaacguauucguuaccuuugagcccguuuuguauaauuucuuguagauguacagaaagaccaccaugauacauaugaauguauuugucuaauauuuuguaacuugguggaaaacaaggaagacagaguguuuuaacaauucucaaaucuuc

SEQ ID NO: 1109 - RNA, 350 nt, artificial sequence
  synthetic construct
guuaguugcuucuccaauaauuucgauaguacuuccacaucggcgaaauaugcuuuuaacaucgauuugucaugcacagauugauuugguaguuuguguaacucaaauaguaggucgucucucgaguucucuaaaucccuuaaacauugauguguaugaagcaauuuuccuucguuaauccaagcuuucguuuucucaacacuuuccggaacaguaaaaauaugcuugagguuuucuuuagcuguuacguauugugaaugacgcauauuuucaucucuaauaucgauaagcuucuugcugaguucaggcacgucggcaaacaauucagacauuuucuucauacuaucauc

SEQ ID NO: 1110 - RNA, 352 nt, artificial sequence
  synthetic construct
guuaguugcuucuccaauaauuucgauaguacuuccacaucggcgaaauaugcuuuuaacaucgauuugucaugcacagauugauuugguaguuuguguaacucaaauaguaggucgucucucgaguucucuaaaucccuuaaacauugauguguaugaagcaauuuuccuucguuaauccaagcuuucguuuucucaacacuuuccggaacaguaaaaauaugcuugagguuuucuuuagcuguuacguauugugaaugacgcauauuuucaucucuaauaucgauaagcuucuugcugaguucaggcacgucggcaaacaauucagacauuuucuucauacuaucaucgc

SEQ ID NO: 1111 - RNA, 351 nt, artificial sequence
  synthetic construct
gcgcaaggcuguuacgauuacugucgggucuuuucuuacuguauuuaagguucuagauaaaaugaacguuaguugcuucuccaauaauuucgauaguacuuccacaucggcgaaauaugcuuuuaacaucgauuugucaugcacagauugauuugguaguuuguguaacucaaauaguaggucgucucucgaguucucuaaaucccuuaaacauugauguguaugaagcaauuuuccuucguuaauccaagcuuucguuuucucaacacuuuccggaacaguaaaaauaugcuugagguuuucuuuagcuguuacguauugugaaugacgcauauuuucaucucuaauauc

SEQ ID NO: 1112 - RNA, 352 nt, artificial sequence
  synthetic construct
guauaagucgcuuuuaaugcuccaaaauuccuaguaaguucaugcgaacuguuguuaguaacauauucuuuuuccaauugagaaccuaauucaacaaguugcaggauauuguugauaauuaagaucauguauugaguaaaauauacaacuuguuuccugucuucaaaauauuuauucuugaauucgauaaucgcuucucuaaaagcaucugcaaauauaauuacuugcuggaugcuuaaauuuaguacuuuuauuguuaauucuucacuuauuguuuuggcuacuugcaaauucugaucaaucauuugaaauauaauaaugggggccgguguccgagaauacgauucugagc

SEQ ID NO: 1113 - RNA, 350 nt, artificial sequence
  synthetic construct
gcccguuuuguauaauuucuuguagauguacagaaagaccaccaugauacauaugaauguauuugucuaauauuuuguaacuugguggaaaacaaggaagacagaguguuuuaacaauucucaaaucuucuaagaucaucauucuaauuaguucuaaauaacguauaagccaauguuuauuguccucucuuucuucaacuugaguacccucgauuuuggaugacacggucuucuccaaaauuuuaaaagccauuucucuccauuucuucggucgagcuggaggaaugaauccaguuuguuuuuguugcuuuaaagcuucuucguccgcuuuuucuucucuuucuaugauc

SEQ ID NO: 1114 - RNA, 352 nt, artificial sequence
  synthetic construct
gcguugaacuagcugaacaguaggaauugguucuuuguaaaccagguaauacuguugggccauuuuacgcgcuugcuugaccaacaaacgguagucgggucccaucccggaauagaccauuccgaugugcuucgugaucauuuccacuuuguggacgcuguguucgucguaaagaauggauuugugcuuguuuuccguggcuauuaccacuccauuugaugcuuuuauuccuacugacggagcaccagccgcuacugccgcuaaagcauauucgauuuggacuaguuuaccugaagggcugaaaguuguuaaagaaaaacuauaacguucagaugacauuuucacaaaugac

SEQ ID NO: 1115 - RNA, 352 nt, artificial sequence
  synthetic construct
guauuccugcaucacaguggcuacacguugaacuagcugaacaguaggaauugguucuuuguaaaccagguaauacuguugggccauuuuacgcgcuugcuugaccaacaaacgguagucgggucccaucccggaauagaccauuccgaugugcuucgugaucauuuccacuuuguggacgcuguguucgucguaaagaauggauuugugcuuguuuuccguggcuauuaccacuccauuugaugcuuuuauuccuacugacggagcaccagccgcuacugccgcuaaagcauauucgauuuggacuaguuuaccugaagggcugaaaguuguuaaagaaaaacuauaacgc

SEQ ID NO: 1116 - RNA, 351 nt, artificial sequence
  synthetic construct
guaaggaauauuugccaaaaaaucuuuuacuguagaaggaucgaaucuccuaaauccuuguggaucgcauaugccaaccucgauguuaucagcggucauuuggcccucgaaacuuucuuuaagcguuaaaauggcggugugcacagcaucauccaauuccaacucuucgcuauaccuuuucucgaggaaggucuucccguugacguaauucuuucccauugcgguggcuuuccaagcgaaauacgccccggaaggaucgcacuggaauaaguaaggccuguuguugucccauccgcagaucaacagggacacuccgaagggucuaacucccccggauugaguguauuccuc

SEQ ID NO: 1117 - RNA, 351 nt, artificial sequence
  synthetic construct
gucggucccaguaggugcaaucagccgcgccuccugccauuguagcuaguagaaaacuguugauuuuuaugauuuucucuacaguuugugauccaaugaauuggccgccaguggcucgggaauccacugcgagcacuacgcccccuuuguacaugaaucccaauguggugguaccguggucgaacuugauuuugaucucacggccguuaucaucuuuggugaaccuugcaaaguuguugcugggaucaggaaaagggggaacagcuaaguucaugccauucuugaaauuggugcaauacuucugcaggcucucgucguaggcgagucgcucguaauccucggaauuguagc

SEQ ID NO: 1118 - RNA, 350 nt, artificial sequence
  synthetic construct
gcaagcgccacccaucuucuccuuuuccuccacaaacuuguaaugcaaguccaugcaaucauuaucaucgaugugcacccagccagucuccuucaugugguacacucuaacaauaccaccugaauaggcgucucugugaguagcgugguaaaucgaucuacgaccuaaaucauaagcuuccucaucggauaagucccauuuguacccagaauccagcaccccgaaagcguaaauggaacccgaaccuacgcugaacacuuucccggcuguccuuagaccuucugaaucgacauaguagaguugaggaccccuuuugucccauccagccagcaucauucccauggacaagc

SEQ ID NO: 1119 - RNA, 352 nt, artificial sequence
  synthetic construct
guuuagcuaauacucggucccaguaggugcaaucagccgcgccuccugccauuguagcuaguagaaaacuguugauuuuuaugauuuucucuacaguuugugauccaaugaauuggccgccaguggcucgggaauccacugcgagcacuacgcccccuuuguacaugaaucccaauguggugguaccguggucgaacuugauuuugaucucacggccguuaucaucuuuggugaaccuugcaaaguuguugcugggaucaggaaaagggggaacagcuaaguucaugccauucuugaaauuggugcaauacuucugcaggcucucgucguaggcgagucgcucguaauccuc

SEQ ID NO: 1120 - RNA, 352 nt, artificial sequence
  synthetic construct
guuguuuagcuaauacucggucccaguaggugcaaucagccgcgccuccugccauuguagcuaguagaaaacuguugauuuuuaugauuuucucuacaguuugugauccaaugaauuggccgccaguggcucgggaauccacugcgagcacuacgcccccuuuguacaugaaucccaauguggugguaccguggucgaacuugauuuugaucucacggccguuaucaucuuuggugaaccuugcaaaguuguugcugggaucaggaaaagggggaacagcuaaguucaugccauucuugaaauuggugcaauacuucugcaggcucucgucguaggcgagucgcucguaauc

SEQ ID NO: 1121 - RNA, 351 nt, artificial sequence
  synthetic construct
gcauucccauggacaagcccauucccuuguaauuauaaaccauguuggccauuaacuuggaagccgcagccaccgagauacguucccuguuucucagcucguacagccuacauuguuuagcuaauacucggucccaguaggugcaaucagccgcgccuccugccauuguagcuaguagaaaacuguugauuuuuaugauuuucucuacaguuugugauccaaugaauuggccgccaguggcucgggaauccacugcgagcacuacgcccccuuuguacaugaaucccaauguggugguaccguggucgaacuugauuuugaucucacggccguuaucaucuuuggugaacc

SEQ ID NO: 1122 - RNA, 351 nt, artificial sequence
  synthetic construct
guuucucagcucguacagccuacauuguuuagcuaauacucggucccaguaggugcaaucagccgcgccuccugccauuguagcuaguagaaaacuguugauuuuuaugauuuucucuacaguuugugauccaaugaauuggccgccaguggcucgggaauccacugcgagcacuacgcccccuuuguacaugaaucccaauguggugguaccguggucgaacuugauuuugaucucacggccguuaucaucuuuggugaaccuugcaaaguuguugcugggaucaggaaaagggggaacagcuaaguucaugccauucuugaaauuggugcaauacuucugcaggcucuc

SEQ ID NO: 1123 - RNA, 352 nt, artificial sequence
  synthetic construct
gcaguaggugcaaucagccgcgccuccugccauuguagcuaguagaaaacuguugauuuuuaugauuuucucuacaguuugugauccaaugaauuggccgccaguggcucgggaauccacugcgagcacuacgcccccuuuguacaugaaucccaauguggugguaccguggucgaacuugauuuugaucucacggccguuaucaucuuuggugaaccuugcaaaguuguugcugggaucaggaaaagggggaacagcuaaguucaugccauucuugaaauuggugcaauacuucugcaggcucucgucguaggcgagucgcucguaauccucggaauuguagcuuguaauc

SEQ ID NO: 1124 - RNA, 352 nt, artificial sequence
  synthetic construct
guaauuauaaaccauguuggccauuaacuuggaagccgcagccaccgagauacguucccuguuucucagcucguacagccuacauuguuuagcuaauacucggucccaguaggugcaaucagccgcgccuccugccauuguagcuaguagaaaacuguugauuuuuaugauuuucucuacaguuugugauccaaugaauuggccgccaguggcucgggaauccacugcgagcacuacgcccccuuuguacaugaaucccaauguggugguaccguggucgaacuugauuuugaucucacggccguuaucaucuuuggugaaccuugcaaaguuguugcugggaucaggaaac

SEQ ID NO: 1125 - RNA, 350 nt, artificial sequence
  synthetic construct
guacccagaauccagcaccccgaaagcguaaauggaacccgaaccuacgcugaacacuuucccggcuguccuuagaccuucugaaucgacauaguagaguugaggaccccuuuugucccauccagccagcaucauucccauggacaagcccauucccuuguaauuauaaaccauguuggccauuaacuuggaagccgcagccaccgagauacguucccuguuucucagcucguacagccuacauuguuuagcuaauacucggucccaguaggugcaaucagccgcgccuccugccauuguagcuaguagaaaacuguugauuuuuaugauuuucucuacaguuugugauc

SEQ ID NO: 1126 - RNA, 351 nt, artificial sequence
  synthetic construct
guauuuuuuaguagcagcggcagcuucgucuucccgcugguaauucugcaaaacuuccugcuucuucguagcgauacguucuucgcgucucucccuggcccguuucaccuucauucucuuggcguucgccuggucggccaacaucuuggcgcgcgccuucucggccuucuucuuguggauguauuccaucaggacgcgcuuguucuugaacacguuacccuucgccuucauguacagcgaaugguacagaugccugucgauuuucuuggccucgcgguacuucuucaacaaacgacggagcacccucauacguugaauccauaauucuuuucuugguguucgagcguucgc

SEQ ID NO: 1127 - RNA, 351 nt, artificial sequence
  synthetic construct
guuacccuucgccuucauguacagcgaaugguacagaugccugucgauuuucuuggccucgcgguacuucuucaacaaacgacggagcacccucauacguugaauccauaauucuuuucuugguguucgagcguucgcuguaccuuuccuuuuaccgaaaccgcagugccugcccuuccugcgggcuucgguguucuugcggacgcgggcgcgcgagugcaccgccacgggcuucuugaugaucagaccgucuuugaucagcuugcggauguuuugucgugaauuuguguuggcgauuucguugauuucguugggauccaaccauaccuucuuuuugccgcaucucauaac

SEQ ID NO: 1128 - RNA, 352 nt, artificial sequence
  synthetic construct
gucgauuuucuuggccucgcgguacuucuucaacaaacgacggagcacccucauacguugaauccauaauucuuuucuugguguucgagcguucgcuguaccuuuccuuuuaccgaaaccgcagugccugcccuuccugcgggcuucgguguucuugcggacgcgggcgcgcgagugcaccgccacgggcuucuugaugaucagaccgucuuugaucagcuugcggauguuuugucgugaauuuguguuggcgauuucguugauuucguugggauccaaccauaccuucuuuuugccgcaucucauaacagaggcugcgagccucuucuggaguuuuaacgaacucauuuuc

SEQ ID NO: 1129 - RNA, 351 nt, artificial sequence
  synthetic construct
gaugccugucgauuuucuuggccucgcgguacuucuucaacaaacgacggagcacccucauacguugaauccauaauucuuuucuugguguucgagcguucgcuguaccuuuccuuuuaccgaaaccgcagugccugcccuuccugcgggcuucgguguucuugcggacgcgggcgcgcgagugcaccgccacgggcuucuugaugaucagaccgucuuugaucagcuugcggauguuuugucgugaauuuguguuggcgauuucguugauuucguugggauccaaccauaccuucuuuuugccgcaucucauaacagaggcugcgagccucuucuggaguuuuaacgaac

SEQ ID NO: 1130 - RNA, 350 nt, artificial sequence
  synthetic construct
gccuucauguacagcgaaugguacagaugccugucgauuuucuuggccucgcgguacuucuucaacaaacgacggagcacccucauacguugaauccauaauucuuuucuugguguucgagcguucgcuguaccuuuccuuuuaccgaaaccgcagugccugcccuuccugcgggcuucgguguucuugcggacgcgggcgcgcgagugcaccgccacgggcuucuugaugaucagaccgucuuugaucagcuugcggauguuuugucgugaauuuguguuggcgauuucguugauuucguugggauccaaccauaccuucuuuuugccgcaucucauaacagaggcugc

SEQ ID NO: 1131 - RNA, 352 nt, artificial sequence
  synthetic construct
guacccuucgccuucauguacagcgaaugguacagaugccugucgauuuucuuggccucgcgguacuucuucaacaaacgacggagcacccucauacguugaauccauaauucuuuucuugguguucgagcguucgcuguaccuuuccuuuuaccgaaaccgcagugccugcccuuccugcgggcuucgguguucuugcggacgcgggcgcgcgagugcaccgccacgggcuucuugaugaucagaccgucuuugaucagcuugcggauguuuugucgugaauuuguguuggcgauuucguugauuucguugggauccaaccauaccuucuuuuugccgcaucucauaacac

SEQ ID NO: 1132 - RNA, 351 nt, artificial sequence
  synthetic construct
guaacucgaagcagcagcugcagcuggagccgcagucuugucuucuuccuuaacucuaucuuucuuaaggggucccaugaacgcagccuugucggcggcgguuuggaaucuaccguguccgaauuuggacgacguaucgaugaauuucaaauugaucuucuccaaagcaauacgcuuagugugaaccaagagagauuuucucaguguaaugacgcgcuucuuagguccaauacaacaacccuuaaucaugacgaagucguuguuaacuucaccguaaugagggaaaccacccaucgguguaauaguuuucucacuaagaucguaaucgguagcagcauuguuuuugaugac

SEQ ID NO: 1133 - RNA, 351 nt, artificial sequence
  synthetic construct
gcuucguaugccaacgagauguaacaccuuuguauccaugaccuuugguuacaccgaugcaaucgaucaucucaucuugagcgaaaacguugccaacgggaaugggcuucuccaaaugcuccuuagcccaugccacuuugucggcaaugguaccgccguugaguugaauuuccauaaugugggcuuucuuuuggcguuguuucaacaauuucaucugagugugagcgaugacucugacaaccuugcaguauuugacgauuuucuucaagucgcgcucaauugacuuuuuacccaaaucgucgguccauuucuuggaugccuuggugaaggccuucuucuugcucuuguacc

SEQ ID NO: 1134 - RNA, 352 nt, artificial sequence
  synthetic construct
guuccuuaacucuaucuuucuuaaggggucccaugaacgcagccuugucggcggcgguuuggaaucuaccguguccgaauuuggacgacguaucgaugaauuucaaauugaucuucuccaaagcaauacgcuuagugugaaccaagagagauuuucucaguguaaugacgcgcuucuuagguccaauacaacaacccuuaaucaugacgaagucguuguuaacuucaccguaaugagggaaaccacccaucgguguaauaguuuucucacuaagaucguaaucgguagcagcauuguuuuugaugaccuuuccguccuuagugugaauuccagcgccgauucuguagauuuc

SEQ ID NO: 1135 - RNA, 352 nt, artificial sequence
  synthetic construct
guuucaaauugaucuucuccaaagcaauacgcuuagugugaaccaagagagauuuucucaguguaaugacgcgcuucuuagguccaauacaacaacccuuaaucaugacgaagucguuguuaacuucaccguaaugagggaaaccacccaucgguguaauaguuuucucacuaagaucguaaucgguagcagcauuguuuuugaugaccuuuccguccuuagugugaauuccagcgccgauucuguagauuuucuuguucaucuccguccugugaugguaacccuuuugaccagcacgagcgacagugaacgacacucgagaaggaugccaggcuccaauacaggcgacuuc

SEQ ID NO: 1136 - RNA, 352 nt, artificial sequence
  synthetic construct
guugucuucuuccuuaacucuaucuuucuuaaggggucccaugaacgcagccuugucggcggcgguuuggaaucuaccguguccgaauuuggacgacguaucgaugaauuucaaauugaucuucuccaaagcaauacgcuuagugugaaccaagagagauuuucucaguguaaugacgcgcuucuuagguccaauacaacaacccuuaaucaugacgaagucguuguuaacuucaccguaaugagggaaaccacccaucgguguaauaguuuucucacuaagaucguaaucgguagcagcauuguuuuugaugaccuuuccguccuuagugugaauuccagcgccgauucuc

SEQ ID NO: 1137 - RNA, 350 nt, artificial sequence
  synthetic construct
gcaaugguaccgccguugaguugaauuuccauaaugugggcuuucuuuuggcguuguuucaacaauuucaucugagugugagcgaugacucugacaaccuugcaguauuugacgauuuucuucaagucgcgcucaauugacuuuuuacccaaaucgucgguccauuucuuggaugccuuggugaaggccuucuucuugcucuuguaccaguucuuguagaaacgucuacggcaaucuucagacaaauguucagcccaaacgguggccaaagcccucaugccauguggaguuucgauguaacccacaacgccuacuacaaucaucggagggguuuccaaaauggucacagc

SEQ ID NO: 1138 - RNA, 352 nt, artificial sequence
  synthetic construct
gaugacucugacaaccuugcaguauuugacgauuuucuucaagucgcgcucaauugacuuuuuacccaaaucgucgguccauuucuuggaugccuuggugaaggccuucuucuugcucuuguaccaguucuuguagaaacgucuacggcaaucuucagacaaauguucagcccaaacgguggccaaagcccucaugccauguggaguuucgauguaacccacaacgccuacuacaaucaucggagggguuuccaaaauggucacagccucuacgauuuccuucuuguugauuuucgaaccaggccugucugccucacguagcacgugggucauaccggcuuuguagccaauc

SEQ ID NO: 1139 - RNA, 349 nt, artificial sequence
  synthetic construct
ggaggaauucccucuuugucuugaauuuuggccuuaacauuuucgauaguaucagaugguucaacuucaagaguaauuguuuuaccaguaagaguuuuaacgaauauuugcauuccuccacguagacgaagaacuaaaugcaguguggacucuuuuugaauauuguagucagacaauguucugccaucuuccaguuguuuaccggcgaagauuaaacguugcugaucuggaggaauccccucuuugucuuggauuuucgccuuaacguucucaauaguaucagaugguucaacuucgaggguuauaguuuuaccaguaaggguuuuaacgaauauuugcaucccuccac

SEQ ID NO: 1140 - RNA, 352 nt, artificial sequence
  synthetic construct
guaacauuuucgauaguaucagaugguucaacuucaagaguaauuguuuuaccaguaagaguuuuaacgaauauuugcauuccuccacguagacgaagaacuaaaugcaguguggacucuuuuugaauauuguagucagacaauguucugccaucuuccaguuguuuaccggcgaagauuaaacguugcugaucuggaggaauccccucuuugucuuggauuuucgccuuaacguucucaauaguaucagaugguucaacuucgaggguuauaguuuuaccaguaaggguuuuaacgaauauuugcaucccuccacggagacgaaguacuaaauguagaguagauucuuuuc

SEQ ID NO: 1141 - RNA, 351 nt, artificial sequence
  synthetic construct
guucaacuucaagaguaauuguuuuaccaguaagaguuuuaacgaauauuugcauuccuccacguagacgaagaacuaaaugcaguguggacucuuuuugaauauuguagucagacaauguucugccaucuuccaguuguuuaccggcgaagauuaaacguugcugaucuggaggaauccccucuuugucuuggauuuucgccuuaacguucucaauaguaucagaugguucaacuucgaggguuauaguuuuaccaguaaggguuuuaacgaauauuugcaucccuccacggagacgaaguacuaaauguagaguagauucuuuuugaauauuguagucagauaagguuc

SEQ ID NO: 1142 - RNA, 350 nt, artificial sequence
  synthetic construct
gaguaauuguuuuaccaguaagaguuuuaacgaauauuugcauuccuccacguagacgaagaacuaaaugcaguguggacucuuuuugaauauuguagucagacaauguucugccaucuuccaguuguuuaccggcgaagauuaaacguugcugaucuggaggaauccccucuuugucuuggauuuucgccuuaacguucucaauaguaucagaugguucaacuucgaggguuauaguuuuaccaguaaggguuuuaacgaauauuugcaucccuccacggagacgaaguacuaaauguagaguagauucuuuuugaauauuguagucagauaagguucuuccaucuucc

SEQ ID NO: 1143 - RNA, 256 nt, artificial sequence
  synthetic construct
guagaaguuuuuggcuaagauuccaucuuucuucguuaaccucacaauacaaucguccgauucucccauacgccugauagcuccgcagagggcguagcuuuuggaacuuucggucauccuuccgguuaaaggaucgacaucggcuacgcugaguugaaugcuagcgugguccuuagcaugaauaauucuguugcuagcagagcauuuccuugggcaguacaagucgacgguuucaccagcgucguuuuccauguuc

SEQ ID NO: 1144 - RNA, 351 nt, artificial sequence
  synthetic construct
guaguguguuuuugcagcuagccuuuuaucccuuucuucggcuauggacaacuuaacacccuuaccucuuggaagagauacaaaggcuuuagcuccuuuaccaaucacgaauacauuauuuaaucuaguugcaaaagcaugaccauuggcguccuuaauguguacaauaucgaaggaaccgggaugacgcucccuguucauaauuguaccaacacgucccaaauuucuaccuccgguaaucaugcacaaguuguuugauucaaacuugauguaauccagaauuuucgacguagcgaucucuaguugaauggugucauucaccuugauauuaggaucaggauaacggauggc

SEQ ID NO: 1145 - RNA, 351 nt, artificial sequence
  synthetic construct
gaugaccauuggcguccuuaauguguacaauaucgaaggaaccgggaugacgcucccuguucauaauuguaccaacacgucccaaauuucuaccuccgguaaucaugcacaaguuguuugauucaaacuugauguaauccagaauuuucgacguagcgaucucuaguugaauggugucauucaccuugauauuaggaucaggauaacggaugguacguccaucaugggucaccaaaaacggaauuccuuucggaccaguuugaacccucuuaacuuugcacaguuuguauuuagcuucuucagcaguaauacggugaauagcgaaucugccuuuuacaucauagaugagac

SEQ ID NO: 1146 - RNA, 352 nt, artificial sequence
  synthetic construct
gcaaucacgaauacauuauuuaaucuaguugcaaaagcaugaccauuggcguccuuaauguguacaauaucgaaggaaccgggaugacgcucccuguucauaauuguaccaacacgucccaaauuucuaccuccgguaaucaugcacaaguuguuugauucaaacuugauguaauccagaauuuucgacguagcgaucucuaguugaauggugucauucaccuugauauuaggaucaggauaacggaugguacguccaucaugggucaccaaaaacggaauuccuuucggaccaguuugaacccucuuaacuuugcacaguuuguauuuagcuucuucagcaguaauacggc

SEQ ID NO: 1147 - RNA, 351 nt, artificial sequence
  synthetic construct
gugacgcucccuguucauaauuguaccaacacgucccaaauuucuaccuccgguaaucaugcacaaguuguuugauucaaacuugauguaauccagaauuuucgacguagcgaucucuaguugaauggugucauucaccuugauauuaggaucaggauaacggaugguacguccaucaugggucaccaaaaacggaauuccuuucggaccaguuugaacccucuuaacuuugcacaguuuguauuuagcuucuucagcaguaauacggugaauagcgaaucugccuuuuacaucauagaugagacggaagaauucaccaguuuucucaauggugauaacauccauaaaacc

SEQ ID NO: 1148 - RNA, 352 nt, artificial sequence
  synthetic construct
gugaccauuggcguccuuaauguguacaauaucgaaggaaccgggaugacgcucccuguucauaauuguaccaacacgucccaaauuucuaccuccgguaaucaugcacaaguuguuugauucaaacuugauguaauccagaauuuucgacguagcgaucucuaguugaauggugucauucaccuugauauuaggaucaggauaacggaugguacguccaucaugggucaccaaaaacggaauuccuuucggaccaguuugaacccucuuaacuuugcacaguuuguauuuagcuucuucagcaguaauacggugaauagcgaaucugccuuuuacaucauagaugagacgc

SEQ ID NO: 1149 - RNA, 351 nt, artificial sequence
  synthetic construct
gaccauuggcguccuuaauguguacaauaucgaaggaaccgggaugacgcucccuguucauaauuguaccaacacgucccaaauuucuaccuccgguaaucaugcacaaguuguuugauucaaacuugauguaauccagaauuuucgacguagcgaucucuaguugaauggugucauucaccuugauauuaggaucaggauaacggaugguacguccaucaugggucaccaaaaacggaauuccuuucggaccaguuugaacccucuuaacuuugcacaguuuguauuuagcuucuucagcaguaauacggugaauagcgaaucugccuuuuacaucauagaugagacggc

SEQ ID NO: 1150 - RNA, 351 nt, artificial sequence
  synthetic construct
gaaggaaccgggaugacgcucccuguucauaauuguaccaacacgucccaaauuucuaccuccgguaaucaugcacaaguuguuugauucaaacuugauguaauccagaauuuucgacguagcgaucucuaguugaauggugucauucaccuugauauuaggaucaggauaacggaugguacguccaucaugggucaccaaaaacggaauuccuuucggaccaguuugaacccucuuaacuuugcacaguuuguauuuagcuucuucagcaguaauacggugaauagcgaaucugccuuuuacaucauagaugagacggaagaauucaccaguuuucucaauggugauaac

SEQ ID NO: 1151 - RNA, 350 nt, artificial sequence
  synthetic construct
gaaccgggaugacgcucccuguucauaauuguaccaacacgucccaaauuucuaccuccgguaaucaugcacaaguuguuugauucaaacuugauguaauccagaauuuucgacguagcgaucucuaguugaauggugucauucaccuugauauuaggaucaggauaacggaugguacguccaucaugggucaccaaaaacggaauuccuuucggaccaguuugaacccucuuaacuuugcacaguuuguauuuagcuucuucagcaguaauacggugaauagcgaaucugccuuuuacaucauagaugagacggaagaauucaccaguuuucucaauggugauaacauc

SEQ ID NO: 1152 - RNA, 351 nt, artificial sequence
  synthetic construct
gcggguuccaccaauuccucuucaccagguuucaaauugcgaaccauaauaaucccuccgaucgaaacauccuucauugcaacguauugcgaguuaucauuaagcguaaucacuuucagcuguugccucaugguccuggcaggauuuugcaggauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuucucuucgguuuucuucuccuucuccuccuucucgggcuucuuaucgucuuuaucuucguccacaucc

SEQ ID NO: 1153 - RNA, 350 nt, artificial sequence
  synthetic construct
guuccuuuucaucaucgcccuuuggaccgaaugcugcuacggguuccaccaauuccucuucaccagguuucaaauugcgaaccauaauaaucccuccgaucgaaacauccuucauugcaacguauugcgaguuaucauuaagcguaaucacuuucagcuguugccucaugguccuggcaggauuuugcaggauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuucucuucgguuuucuucuccuucuccucc

SEQ ID NO: 1154 - RNA, 350 nt, artificial sequence
  synthetic construct
gcugcuacggguuccaccaauuccucuucaccagguuucaaauugcgaaccauaauaaucccuccgaucgaaacauccuucauugcaacguauugcgaguuaucauuaagcguaaucacuuucagcuguugccucaugguccuggcaggauuuugcaggauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuucucuucgguuuucuucuccuucuccuccuucucgggcuucuuaucgucuuuaucuucguc

SEQ ID NO: 1155 - RNA, 351 nt, artificial sequence
  synthetic construct
guacaugccggaucuucucaggauuggauccuuaucagaaguaagcuguuguauuaggguaucagcuucuucuaaucggccguacaucgugaagcuuauaccaacagccaaaccgcgaagaaucuuuucguguugacucucuugcgcguacgcuaccauauccauaaucguaguggaauuacuggauccuaacauaaccaugcccaucgcaauuccagcggccucuccgguauuagcaucaucuugauagagauugaacuucagcuguucguagacaucuugccuguguguccccauggcagccaaaccaagcccuaaacaaccgccgugccuaaccaucucauucugagc

SEQ ID NO: 1156 - RNA, 247 nt, artificial sequence
  synthetic construct
gucccaucccggaauagaccauuccgaugugcuucgugaucauuucuacuuuauggacgcuguguucgucguaaagaauggauuugugcuuguuuucuguggcuauuaccacuccauuugaugcuuuuauuccuacugaaggagcaccagccgccacugccgcuaaagcauauucgauuuggacuaguuuaccugaagggcugaaaguuguuaaagaaaaacuauaacguucagaugacauuuucac

SEQ ID NO: 1157 - RNA, 247 nt, artificial sequence
  synthetic construct
gcgccacccauuuucuccuuuuccuccacaaacuuguaaugcaaguccaugcaaucauuaucaucgaugugcacccaaccagucucuuucaugugguacacucuaacaauaccuccugaauaggcgucucuaugaguagcgugguaaaucgaucuacgaccuaaaucauaagcuuccucaucggauaagucccauuuguauccagaaucaagcaccccgaaagcguaaauggaaccugaaccuacgc

SEQ ID NO: 1158 - RNA, 259 nt, artificial sequence
  synthetic construct
guacuuuuucaacaaacgacgaaggacucucauacguugaauccauaauucuuuucuugguguucgagcguucgcuguaccuuuccuuuuaccaaaaccgcagugccuacccuuccugcgggcuucgguguucuugcggacacgggcacgugagugcacugcuacaggcuucuugaugaucaaaccaucuuuaaucagcuugcggauguuuugucuugaauuuguauuggcgauuucguugauuucguuaggauccaac

SEQ ID NO: 1159 - RNA, 268 nt, artificial sequence
  synthetic construct
gucuucuuccuuaacucuaucuuucuuaagaggucccauaaacgcagccuugucggcggcgguuuggaaucuaccguguccgaauuuggacgacguaucgaugaauuucaaauugaucuucuccaaagcaauacgcuuagugugaaccaagagagauuuucucaguguaaugacacgcuucuuaggucccauacaacaacccuuaaucaugacgaagucauuguuaacuucaccauaaugagggaaaccacccauugguguaaugguc

SEQ ID NO: 1160 - RNA, 249 nt, artificial sequence
  synthetic construct
gauaagguucuuccaucuuccaguuguuugccagcgaaaauuaaacguugcugaucuggaggaauacccucuuugucuuggauuuucgccuucacguucucaauaguaucagaugguucaacuucgagggugauaguuuuaccaguaaggguuuuaacgaauauuugcaucccaccacggagacgaagaacuaagugcaauguggacucuuucugaauguuguagucagacaagguucuuccaucuucc

SEQ ID NO: 1161 - RNA, 247 nt, artificial sequence
  synthetic construct
gaaguuuuuggcuaggauuccaucuuucuucguuaaccucacaauacaaucguccgauucucccauacgccugauagcuccgcagagagcguagcucuuggaacuuucggucauucuuccgguuaaaggaucaacgucggcgacgcugaguugaaugcuagcgugguccuuagcaugaauaauucuguugcuagcagagcauuuucuugggcaguacaagucgacgguuucaccagcgucguuuucc

SEQ ID NO: 1162 - RNA, 266 nt, artificial sequence
  synthetic construct
gacguagcgaucuccaauugaauugugucguuuaccuugaugacaggaucaggguaacggauuguacgaccaucgugggucaccaaaaacggaauuccuuugggaccgguuugaacccucuuaacuuugcaaagcuuguauuuagcuucuucagcaguaauacgguggauagcaaaucuuccuuucacaucauagaugagacggaaaaauucaccaguuuuuucaauggugauaacauccauaaaaccugcgggguaguuggaguc

SEQ ID NO: 1163 - RNA, 258 nt, artificial sequence
  synthetic construct
gauagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuuc

SEQ ID NO: 1164 - RNA, 230 nt, artificial sequence
  synthetic construct
gacauauucuucucugaauccuucugcaugaccuuggccacagccauuucgaaaucuucuuggguuacguguacccuucucucccuuagggcguacaugccugccucaguacacacucccuucacuucggcaccgcuggcaccuggcaucaauucggcgauuuuccucaaauugaucccucuggucaaauucauuuuucucgagugaauuuucaagauguccaaucgggc

SEQ ID NO: 1165 - RNA, 252 nt, artificial sequence
  synthetic construct
gccguugaaacuguaacuguacaaaauugguugaaucaugaucaaugauugaguaagaucuucucucaucaacauaugucuauagaacgacguuucaucaggagaauuauugaaaacuugcaagaacugagaccuccuuagaugguacaugaauugcggauagaggcuaaaguuuuggccuaaucugaaugaaccagcaucgucuuuauuguauucuccgaauuuuugacacaaucgaaucagcauucuauc

SEQ ID NO: 1166 - RNA, 273 nt, artificial sequence
  synthetic construct
gcuuucuaauucauccucguccaaaucaucagcgaagccuaccggcuggcuaauagcaguaguaaucucguuggcaaugucaugcuguucagcuaugucauccaugaugucguggacaucaucgacauucaaguuuuugugggcuuuuuggagagcuucagcugcauucuucauugaaucuaagacggcuguguuggugcuggcuccuucgagggccucccuuugcauuucgauuguagugagugugccaucgauuuguaauugaguuuuuuc

SEQ ID NO: 1167 - RNA, 267 nt, artificial sequence
  synthetic construct
gucccuuugaugauaagcuaugucggcggccucuuccaagcacccggcuuugaugcaguauuugacuuugaugucgucgccgacuuugggcagauauuugagggccuccugccguuuguccugccucaagcaaacguccacgaagggagcguauccgauaggggacuucuucgcuuuggaaaacuuuuccagcucgauccaaucguucugaucggccaggcuguugauuuucaaccaccaauaccuuuuaucgggaauuuugaaguc

SEQ ID NO: 1168 - RNA, 255 nt, artificial sequence
  synthetic construct
gucuucucucacuuucaacaccuucaaucuggccugguucagcauguuggacgauuggauuuucuucuggagcucgacuuguuucuccuucuucucguaguauuccaugaucuugaggcgcugcuguuggaccaaacggcccuuuucuauguugaacuccuccucggcuuuggcaucgauuucuucggccuucucguuggccucuugcucgaugaaagccaucaugugcuugaucuguuucuggacaucugcguc

SEQ ID NO: 1169 - RNA, 267 nt, artificial sequence
  synthetic construct
guacaucccaaucauguucuucaacauacccacgguuuuguagaagggacagaaucuaucguacgaugaguacgaguucuguugcaggaaaucuucuuucaacagcuuggcgauuuccaauguaaucuuaucagcuucagcuaaugaagcuuuuccuaccagcugcacgauuuccguaaggucgucuucuucuugaaggauuucuuuaacuuugguucuuagcgguauaaauucagggaaguuuuugucauagaaaucauccaaagc

SEQ ID NO: 1170 - RNA, 252 nt, artificial sequence
  synthetic construct
ggccacuuucacguuagccuugauauugcagaaauccuucggcgccagaacgaccggcugaggcuucuccaccaacuucaaaucgcccagagucgccaacuccagaguacaauucugcagcgugucgcucguuugguucaccaccaacacguccagcacgauaucguacugauuaacgugcacauacgcuucggaguaaacaggauccgagaaacccgucaacugggcgaucuuguucaauuuacucgagcc

SEQ ID NO: 1171 - RNA, 256 nt, artificial sequence
  synthetic construct
guaugggacaaaaggacuccuacguaggagacgaggcccaaagcaaaagagguauccucacuuugaaauaccccaucgaacacgguaucaucaccaacugggaugacauggaaaagaucuggcaccacaccuucuacaacgaacuccgugucgcuccggaagaacaccccguccucuugaccgaggcuccucuuaacccuaaagccaacagggaaaagaugacccaaaucauguuugaaaccuucaacacaccggc

SEQ ID NO: 1172 - RNA, 284 nt, artificial sequence
  synthetic construct
ggaacgucuucccguugacauaauucuuucccauugcgguggcuuuccaagcgaaauacgccccagaaggaucgcacuggaauaaguaaggccuguuguugucccauccgcagaucaauagggacacuccgaagggucuaacucccccggauugaguguauuccugcauuacaguugcaacacguugaacuagcugaacaguaggaauugguucuuuguaaaccagguaauacuguugggccauuuuacgugcuugcuugaccaacaaacgguagucagguccc

SEQ ID NO: 1173 - RNA, 296 nt, artificial sequence
  synthetic construct
ggaccccuuuugucccauccagccaacaucauucccauggacaaacccauuccuuuguaauuauaaaccauauuggccauuaacuuggaagccgcagccaccgaaauacguucccuguuucucaguucguacagccuacauuguuuagcuaauacucggucccaguacguacaaucagccgcgccuccugccauuguagcuagcaaaaaacuguugauuuuuaugauuuuuucuacaguuugugauccaaugaauuggccuccaguggcucgggaauccacugcgaguacuacgcc

SEQ ID NO: 1174 - RNA, 253 nt, artificial sequence
  synthetic construct
ggcagcuucgucuucccucugguaauucugcaaaacuuccugcuucuucguagcgauacguucuucacgucuuucccuggcgcguuugaccuucauucucuuggcguucgccuggucggccaacaucuuggcgcgagccuucucagccuucuucuuguggauguauuccaucaggacacgcuuguucuugaauacguuacccuuugccuucauguacagcgaaugguacagaugucugucgauuuucuuggcc

SEQ ID NO: 1175 - RNA, 301 nt, artificial sequence
  synthetic construct
ggguaagaaguccauugagcgcgacuugaagaaaaucgucaaauacugcaagguugucagagucaucgcucacacucagaugaaauuguugaaacaacgucaaaagaaagcccauauuauggaaauucaacucaacggagguaccauugccgacaaagucgcaugggcuaaggagcauuuggagaagcccauucccguuggcaacguuuucgcucaagaugagaugaucgauugcaucgguguaaccaaaggucauggauacaaagguguuacaucucguuggcauacgaagaaauugccc

SEQ ID NO: 1176 - RNA, 185 nt, artificial sequence
  synthetic construct
guuuuaguuauuaaagaguuuuaacgaauauuuacaucccuccacggagacgaaguacuaaauguagaguagauucuuuuugaauauuguagucagauaagguucuuccaucuuccaguuguuugccagcgaaaauuaaacguugcugaucuggaggaauacccucuuugucuuggauuuucgcc

SEQ ID NO: 1177 - RNA, 255 nt, artificial sequence
  synthetic construct
ggcaauggauagcuucacaccuuuaccucuuggaagagacacaaaagccuuagcuccuuuaccaauuacgaauacauuauuuaaccuaguagcaaaggcaugaccguuagcauccuuaauauguacaauaucgaaggauccaggaugacguucccuguucaugaucguaccgacacgacccaaauuucuaccuccggugaucauacacaaguuguuggauucaaacuugauguaaucgagaauuuuagacguagc

SEQ ID NO: 1178 - RNA, 300 nt, artificial sequence
  synthetic construct
guguucacgcaguauugguauugguucccucugucgcauugucuggcuuuagcuuuuaccccgacgugcguuauagcguugaauacucaacugaagaugccuaaauuggaguucaaaucgaacgcgaaaccgagcuuguacgccuacccggcgcccauggaggaaaagaaacgcgaggaaagggagaaagucaccaccgccguauugagcauagcugcgaggcaaaggagaagggaucacgagaggaaacaucgcgaugagaaaauggauguggacgaagauaaagacgauaagaaaacc

SEQ ID NO: 1179 - RNA, 279 nt, artificial sequence
  synthetic construct
gggcuuccucguucgguggagggaacucgaucuuccugucaauucugccgggccugaguaaagcgggauccaaaaugucgauucuguuuguagccauuauaacuuuaauguucuucguagccucaaauccaucgaguugauucagcaacuccagcauaguucuuugaacuucggaaucgccaccagaaccugauucgauacgagaggauccaauagaaucgauuucauccaugaaaaugaucgaaggggcaugcucccuagccauuacgaacaguuccc

SEQ ID NO: 1180 - RNA, 226 nt, artificial sequence
  synthetic construct
gaaucagcauucuaucgacccaucucagaacgucgggacucucaucugauucagcucuauaaacagccauucuggccauaauuacagcugcugcuuccugaucaaaaccagcgcugaugugguggauauuaguaguggcaucagcccaguuucgagccacuguugucacucuaauucuucuuugaccacuugaguguugauacugaguaaugaauuguaugcaacc

SEQ ID NO: 1181 - RNA, 197 nt, artificial sequence
  synthetic construct
guuauuaauccaugcgaguuccucuuaugaagcccaagcuuccaauucuuucaugucaucaucauccuccacuuuuuuagcagcagguuuaacgggcuuggcaauagcuccuguagguacagcagguaguucaguugggccuggaacuuucagcaaaucuuccucuaauccuucuuguucgagcuuuucuaguucgc

SEQ ID NO: 1182 - RNA, 300 nt, artificial sequence
  synthetic construct
gaucuucacuuuauucuucagcgccagcaaaucgaucccuccgguggucuccugcgacaagugcgacucaucgucgaucuucaagugcaccucuuugcccgugauguccuuguacuugguuugcacguugcccagaaucgacuugaccagcucccuguccugcgggcgcacccugaccguuacuucuuucucgaacagcugguagaguccuugaaggaugaggcuuucgaugauguggccguacuuucccuggucucgggugacuucgccgaggcgcuugcgggcgucuucuagcacggc

SEQ ID NO: 1183 - RNA, 235 nt, artificial sequence
  synthetic construct
gauauggcgagacacgccguggagucgacugcucaaucugagaacaagaucacguggacggugaucagggauucgaugagcaacauuuuguaccaauugagcaguaugaaguucaaggauccggugaaagauggcgaggcgaagaucaaggcggauuucgaucaguuguacgaggauauccagcaggcguucagaaaucuggaggauuaauucgucgcagguguuaggauuucuc

SEQ ID NO: 1184 - RNA, 272 nt, artificial sequence
  synthetic construct
gcgccuucucugaugucaggcacuucauguuaguacucuucagcagaugcuccagguacucguugagauccgucagcggcguauugacggucaccuuauucucccauucgaauucagcccacauccucauaaacuccgaaucggugcacgaugccggaacaauguaauccauaauaucgauguguaugucguucaaaacgacuacauuccuguccgaagcggcgccugucacgucguacacgauguuaccgaauaugauaccauucucgguc

SEQ ID NO: 1185 - RNA, 270 nt, artificial sequence
  synthetic construct
ggagguggaggcggcggcgguggccauuuccuguucgaagucgagggcgacauagcagaguuucuccuugaugucgcggacgauuucccuuucagcggugguggugaacgaguaaccccuuucggugaggauuuucaugagguagucggucaaaucgcgaccggccaaguccaaacggaggauggcguggggaagagcguaaccuucguagaucgguacgguguggguuacaccgucaccggaguccaauacaauaccggugguacgacc

SEQ ID NO: 1186 - RNA, 333 nt, artificial sequence
  synthetic construct
gugcuaauccucaauccaaucguauccuuuccaacuuccgccacuuugcaaauauuacacaauaccccuuuauauuuagguaaauaagaaguaccgcauaauggacauuucucuucagccuuuccccuauaaauagguguauaagagugcccacacaaguugaaaggauugugcucgucauacugcaauugcaaaucaucuguaagauucgaaucgcaagccugcaauauuuuccucgcuugcugggcuacuucaggccuaggaccgaguucuaacagccucuuggcgaaagaagcagcaguuuuguaguuuuugagcuugaagaacauguuc

SEQ ID NO: 1187 - RNA, 352 nt, artificial sequence
  synthetic construct
gagaugauuucuuuuugcuucgugaguguacgaaccaucgcauucacccacuauuggagagcaaccaauuggcaaaggaauuguaauguuaacguccacuaauucuaaguuagugugggcaaguucguauucaauauucacaucgcaacugccgucuccugcuucagaaggccaacaguuuauuagcagaggcaccagggcuucgucaguacuuugcaaucgccauuuuaauacaccuacgucaguguggagcgggaaugguuucgaaggcuguuuuaaaccaauuucugaacgcaauuugaacaguucuuuaucgacauucgggugcguuugaagcugcacuccgugcguc

SEQ ID NO: 1188 - RNA, 351 nt, artificial sequence
  synthetic construct
gugaauucuaaagaacccgucuuguugcuagcaucaauuaccggcagguuccauacaagaugauuucuuuuugcuucgugaguguacgaaccaucgcauucacccacuauuggagagcaaccaauuggcaaaggaauuguaauguuaacguccacuaauucuaaguuagugugggcaaguucguauucaauauucacaucgcaacugccgucuccugcuucagaaggccaacaguuuauuagcagaggcaccagggcuucgucaguacuuugcaaucgccauuuuaauacaccuacgucaguguggagcgggaaugguuucgaaggcuguuuuaaaccaauuucugaacgc

SEQ ID NO: 1189 - RNA, 352 nt, artificial sequence
  synthetic construct
gcaucaauuaccggcagguuccauacaagaugauuucuuuuugcuucgugaguguacgaaccaucgcauucacccacuauuggagagcaaccaauuggcaaaggaauuguaauguuaacguccacuaauucuaaguuagugugggcaaguucguauucaauauucacaucgcaacugccgucuccugcuucagaaggccaacaguuuauuagcagaggcaccagggcuucgucaguacuuugcaaucgccauuuuaauacaccuacgucaguguggagcgggaaugguuucgaaggcuguuuuaaaccaauuucugaacgcaauuugaacaguucuuuaucgacauucgggc

SEQ ID NO: 1190 - RNA, 352 nt, artificial sequence
  synthetic construct
guguugcuagcaucaauuaccggcagguuccauacaagaugauuucuuuuugcuucgugaguguacgaaccaucgcauucacccacuauuggagagcaaccaauuggcaaaggaauuguaauguuaacguccacuaauucuaaguuagugugggcaaguucguauucaauauucacaucgcaacugccgucuccugcuucagaaggccaacaguuuauuagcagaggcaccagggcuucgucaguacuuugcaaucgccauuuuaauacaccuacgucaguguggagcgggaaugguuucgaaggcuguuuuaaaccaauuucugaacgcaauuugaacaguucuuuaucgc

SEQ ID NO: 1191 - RNA, 351 nt, artificial sequence
  synthetic construct
gcccauaugccuuugaaguguaaucaaauuaaccaguguguccggauaauuagcaucuuuaucuauagcuuccugcaaagcagcuucagcuuccucauauuuagccuguccuauaaaagcaacugcuugcccauucaacagaagaggcgucgagccauauuuaucaaccauuucuugauaaauguaguaagcaucuugcaauuuaucaccuccaauggcaacauuaacccaagcuugcgcuagcuguguuaacguggcaucaucaucuuuauccugcauuuccuugagcuucuucuuagccaaaucuacccgaucuaacuucaauaauauaucgaugaugaaagcguaagc

SEQ ID NO: 1192 - RNA, 352 nt, artificial sequence
  synthetic construct
gcugcaaagcagcuucagcuuccucauauuuagccuguccuauaaaagcaacugcuugcccauucaacagaagaggcgucgagccauauuuaucaaccauuucuugauaaauguaguaagcaucuugcaauuuaucaccuccaauggcaacauuaacccaagcuugcgcuagcuguguuaacguggcaucaucaucuuuauccugcauuuccuugagcuucuucuuagccaaaucuacccgaucuaacuucaauaauauaucgaugaugaaagcguaagcuuccagauuuuccgaagcaugaagcacuuuguaagcggcuuccaaguugccuucguuaacguaaacaguggc

SEQ ID NO: 1193 - RNA, 352 nt, artificial sequence
  synthetic construct
guuucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaaccuucaucgcuaucgggaaugccaguggugggaucgcaaucuuuaacgauaaacuucaacaccgccccgaaaguaccaacgcaacuaggcaaaucgucgucggggaacuucaaaauagcguaggugugauuggucucguuguaaugcagcugcuugcacggcaccaccgacagcaacuc

SEQ ID NO: 1194 - RNA, 352 nt, artificial sequence
  synthetic construct
guucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaaccuucaucgcuaucgggaaugccaguggugggaucgcaaucuuuaacgauaaacuucaacaccgccccgaaaguaccaacgcaacuaggcaaaucgucgucggggaacuucaaaauagcguaggugugauuggucucguuguaaugcagcugcuugcacggcaccaccgacagcaacucgaacccuuc

SEQ ID NO: 1195 - RNA, 352 nt, artificial sequence
  synthetic construct
guuccuccucuaaagacuccugauaguagaagcgugugggugcucuugccuucgggcacuuuaucaguucuuucggccgguugcaauccaaggaacugcacgauauuuuucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaaccuucaucgcuaucgggaaugccaguggugggaucgcaaucuuuaacgauaaacuucaacaccgccccgaaac

SEQ ID NO: 1196 - RNA, 351 nt, artificial sequence
  synthetic construct
guuaccaaaauaucgauuccuccucuaaagacuccugauaguagaagcgugugggugcucuugccuucgggcacuuuaucaguucuuucggccgguugcaauccaaggaacugcacgauauuuuucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaaccuucaucgcuaucgggaaugccaguggugggaucgcaaucuuuaacgauaaacuuc

SEQ ID NO: 1197 - RNA, 351 nt, artificial sequence
  synthetic construct
gucgggugaucuuacagucaguugcauuguaacaccauccgcuaaagcaaguuuagcucuuaccaaaauaucgauuccuccucuaaagacuccugauaguagaagcgugugggugcucuugccuucgggcacuuuaucaguucuuucggccgguugcaauccaaggaacugcacgauauuuuucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguc

SEQ ID NO: 1198 - RNA, 350 nt, artificial sequence
  synthetic construct
ggugaucuuacagucaguugcauuguaacaccauccgcuaaagcaaguuuagcucuuaccaaaauaucgauuccuccucuaaagacuccugauaguagaagcgugugggugcucuugccuucgggcacuuuaucaguucuuucggccgguugcaauccaaggaacugcacgauauuuuucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaacc

SEQ ID NO: 1199 - RNA, 352 nt, artificial sequence
  synthetic construct
gcaguugcauuguaacaccauccgcuaaagcaaguuuagcucuuaccaaaauaucgauuccuccucuaaagacuccugauaguagaagcgugugggugcucuugccuucgggcacuuuaucaguucuuucggccgguugcaauccaaggaacugcacgauauuuuucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaaccuucaucgcuaucggc

SEQ ID NO: 1200 - RNA, 352 nt, artificial sequence
  synthetic construct
guaacaccauccgcuaaagcaaguuuagcucuuaccaaaauaucgauuccuccucuaaagacuccugauaguagaagcgugugggugcucuugccuucgggcacuuuaucaguucuuucggccgguugcaauccaaggaacugcacgauauuuuucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaaccuucaucgcuaucgggaaugccagugc

SEQ ID NO: 1201 - RNA, 351 nt, artificial sequence
  synthetic construct
guauuuuucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaaccuucaucgcuaucgggaaugccaguggugggaucgcaaucuuuaacgauaaacuucaacaccgccccgaaaguaccaacgcaacuaggcaaaucgucgucggggaacuucaaaauagcguaggugugauuggucucguuguaaugcagcugcuugcacggcaccaccgacagc

SEQ ID NO: 1202 - RNA, 351 nt, artificial sequence
  synthetic construct
gccaaaauaucgauuccuccucuaaagacuccugauaguagaagcgugugggugcucuugccuucgggcacuuuaucaguucuuucggccgguugcaauccaaggaacugcacgauauuuuucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaaccuucaucgcuaucgggaaugccaguggugggaucgcaaucuuuaacgauaaacuucaac

SEQ ID NO: 1203 - RNA, 351 nt, artificial sequence
  synthetic construct
guucacagcuucauccaacguauucaucgaacugagagaauacguauccuccuuuuccacggaacccucagcagccgauucccaagcggcgccccaauugaccuugcucacucucuguauuugaucgcccaacguuauuuccaagucuucgaguauguauucaucauuguaaccuucaucgcuaucgggaaugccaguggugggaucgcaaucuuuaacgauaaacuucaacaccgccccgaaaguaccaacgcaacuaggcaaaucgucgucggggaacuucaaaauagcguaggugugauuggucucguuguaaugcagcugcuugcacggcaccaccgacagcaacuc

SEQ ID NO: 1204 - RNA, 351 nt, artificial sequence
  synthetic construct
guaaugaaucuaaaacuacccucuuuuccauauucuuccuuagaauuugacucacggaaucguauaagcaauuuaaaacgcucauuagaauuaacucauuuucaugagaacuacccauaacauagaaaaauaaaucuacguuacuuuuguacacacauguaaggccaucaagcauuauaauuuccgcguucgcccuguggguuuuguugaacagguuuuucucgaaagucuucugcucuuucgcugugggaaauacguuuuugucguaauacuuugccaauauucgguuuccaucauuauccaauauagcuaugccuuuaauggcguucaaaguggguuccaauaacgagc

SEQ ID NO: 1205 - RNA, 352 nt, artificial sequence
  synthetic construct
guaauaaugaccauuucagcuguucuuuggcugauugaaacaccugggcgacuguuugcuccccaaucggaaugucgucguuucuuaaagcaacucucgauaugaccgaguuggaaucggcaucgaugauaaucccuccaucacagauuucauccauggccaacaugacuauaucuaaugaaucuaaaacuacccucuuuuccauauucuuccuuagaauuugacucacggaaucguauaagcaauuuaaaacgcucauuagaauuaacucauuuucaugagaacuacccauaacauagaaaaauaaaucuacguuacuuuuguacacacauguaaggccaucaagcauuac

SEQ ID NO: 1206 - RNA, 351 nt, artificial sequence
  synthetic construct
guaucuaaugaaucuaaaacuacccucuuuuccauauucuuccuuagaauuugacucacggaaucguauaagcaauuuaaaacgcucauuagaauuaacucauuuucaugagaacuacccauaacauagaaaaauaaaucuacguuacuuuuguacacacauguaaggccaucaagcauuauaauuuccgcguucgcccuguggguuuuguugaacagguuuuucucgaaagucuucugcucuuucgcugugggaaauacguuuuugucguaauacuuugccaauauucgguuuccaucauuauccaauauagcuaugccuuuaauggcguucaaaguggguuccaauaac

SEQ ID NO: 1207 - RNA, 352 nt, artificial sequence
  synthetic construct
gacccucuuuuccauauucuuccuuagaauuugacucacggaaucguauaagcaauuuaaaacgcucauuagaauuaacucauuuucaugagaacuacccauaacauagaaaaauaaaucuacguuacuuuuguacacacauguaaggccaucaagcauuauaauuuccgcguucgcccuguggguuuuguugaacagguuuuucucgaaagucuucugcucuuucgcugugggaaauacguuuuugucguaauacuuugccaauauucgguuuccaucauuauccaauauagcuaugccuuuaauggcguucaaaguggguuccaauaacgagccuuccauuagugaauuc

SEQ ID NO: 1208 - RNA, 352 nt, artificial sequence
  synthetic construct
guaaaacuacccucuuuuccauauucuuccuuagaauuugacucacggaaucguauaagcaauuuaaaacgcucauuagaauuaacucauuuucaugagaacuacccauaacauagaaaaauaaaucuacguuacuuuuguacacacauguaaggccaucaagcauuauaauuuccgcguucgcccuguggguuuuguugaacagguuuuucucgaaagucuucugcucuuucgcugugggaaauacguuuuugucguaauacuuugccaauauucgguuuccaucauuauccaauauagcuaugccuuuaauggcguucaaaguggguuccaauaacgagccuuccauuac

SEQ ID NO: 1209 - RNA, 351 nt, artificial sequence
  synthetic construct
guuucuuaaagcaacucucgauaugaccgaguuggaaucggcaucgaugauaaucccuccaucacagauuucauccauggccaacaugacuauaucuaaugaaucuaaaacuacccucuuuuccauauucuuccuuagaauuugacucacggaaucguauaagcaauuuaaaacgcucauuagaauuaacucauuuucaugagaacuacccauaacauagaaaaauaaaucuacguuacuuuuguacacacauguaaggccaucaagcauuauaauuuccgcguucgcccuguggguuuuguugaacagguuuuucucgaaagucuucugcucuuucgcugugggaaauac

SEQ ID NO: 1210 - RNA, 352 nt, artificial sequence
  synthetic construct
guuuuaucuucucuauuaccaaagucaccaccuucaacguagugauuggucuucuugcgccacccaccaguagguguguuuagcuuaaacggccacaagaaguuagaggcguacuuaaacuuagguccaacaguaaaaauuucaugaaucaaaucuuccaugcaaauaauuccagauuugccuaaucugucuucgaugauuugauugcucguaaugggcacucucuguccguucacuuuagcgaaaccucucuuguagaucagcucccugaccgauuucaaguugggguaaccccagguaauguaagguucgcauauucuaagcauguugaugguagccuuguugagcuggc

SEQ ID NO: 1211 - RNA, 351 nt, artificial sequence
  synthetic construct
guacaccauucuucugagaaguucguuaauuuuaucuucucuauuaccaaagucaccaccuucaacguagugauuggucuucuugcgccacccaccaguagguguguuuagcuuaaacggccacaagaaguuagaggcguacuuaaacuuagguccaacaguaaaaauuucaugaaucaaaucuuccaugcaaauaauuccagauuugccuaaucugucuucgaugauuugauugcucguaaugggcacucucuguccguucacuuuagcgaaaccucucuuguagaucagcucccugaccgauuucaaguugggguaaccccagguaauguaagguucgcauauucuaac

SEQ ID NO: 1212 - RNA, 351 nt, artificial sequence
  synthetic construct
gaucugucuucgaugauuugauugcucguaaugggcacucucuguccguucacuuuagcgaaaccucucuuguagaucagcucccugaccgauuucaaguugggguaaccccagguaauguaagguucgcauauucuaagcauguugaugguagccuuguugagcuggacgaacacuccguuguugauuuggagcagccugaacaguuggaggacuuugcgaacuuucggggcaaccuuguugauacccuuaauacgcauuacgaaagcuaauuuagcuuccgcuggaacguagaaguuucccuuguuuuuagcuuggcggaucaaccuaauuucaucucguuccuucagc

SEQ ID NO: 1213 - RNA, 351 nt, artificial sequence
  synthetic construct
gagaaguucguuaauuuuaucuucucuauuaccaaagucaccaccuucaacguagugauuggucuucuugcgccacccaccaguagguguguuuagcuuaaacggccacaagaaguuagaggcguacuuaaacuuagguccaacaguaaaaauuucaugaaucaaaucuuccaugcaaauaauuccagauuugccuaaucugucuucgaugauuugauugcucguaaugggcacucucuguccguucacuuuagcgaaaccucucuuguagaucagcucccugaccgauuucaaguugggguaaccccagguaauguaagguucgcauauucuaagcauguugaugguagc

SEQ ID NO: 1214 - RNA, 352 nt, artificial sequence
  synthetic construct
guucgcauauucuaagcauguugaugguagccuuguugagcuggacgaacacuccguuguugauuuggagcagccugaacaguuggaggacuuugcgaacuuucggggcaaccuuguugauacccuuaauacgcauuacgaaagcuaauuuagcuuccgcuggaacguagaaguuucccuuguuuuuagcuuggcggaucaaccuaauuucaucucguuccuucagccuguacucuuuaauguauuguucggcccucuugaaaauaucuuuccucuucuugaugugcucggauuuucucuucacgauagauuggagccucuuagcucuggaagccucgcgccuuuugcgguc

SEQ ID NO: 1215 - RNA, 352 nt, artificial sequence
  synthetic construct
gcacuuuagcgaaaccucucuuguagaucagcucccugaccgauuucaaguugggguaaccccagguaauguaagguucgcauauucuaagcauguugaugguagccuuguugagcuggacgaacacuccguuguugauuuggagcagccugaacaguuggaggacuuugcgaacuuucggggcaaccuuguugauacccuuaauacgcauuacgaaagcuaauuuagcuuccgcuggaacguagaaguuucccuuguuuuuagcuuggcggaucaaccuaauuucaucucguuccuucagccuguacucuuuaauguauuguucggcccucuugaaaauaucuuuccucuc

SEQ ID NO: 1216 - RNA, 351 nt, artificial sequence
  synthetic construct
guuagaggcguacuuaaacuuagguccaacaguaaaaauuucaugaaucaaaucuuccaugcaaauaauuccagauuugccuaaucugucuucgaugauuugauugcucguaaugggcacucucuguccguucacuuuagcgaaaccucucuuguagaucagcucccugaccgauuucaaguugggguaaccccagguaauguaagguucgcauauucuaagcauguugaugguagccuuguugagcuggacgaacacuccguuguugauuuggagcagccugaacaguuggaggacuuugcgaacuuucggggcaaccuuguugauacccuuaauacgcauuacgaaagc

SEQ ID NO: 1217 - RNA, 352 nt, artificial sequence
  synthetic construct
gucugagaaguucguuaauuuuaucuucucuauuaccaaagucaccaccuucaacguagugauuggucuucuugcgccacccaccaguagguguguuuagcuuaaacggccacaagaaguuagaggcguacuuaaacuuagguccaacaguaaaaauuucaugaaucaaaucuuccaugcaaauaauuccagauuugccuaaucugucuucgaugauuugauugcucguaaugggcacucucuguccguucacuuuagcgaaaccucucuuguagaucagcucccugaccgauuucaaguugggguaaccccagguaauguaagguucgcauauucuaagcauguugauggc

SEQ ID NO: 1218 - RNA, 352 nt, artificial sequence
  synthetic construct
gaccucucuuguagaucagcucccugaccgauuucaaguugggguaaccccagguaauguaagguucgcauauucuaagcauguugaugguagccuuguugagcuggacgaacacuccguuguugauuuggagcagccugaacaguuggaggacuuugcgaacuuucggggcaaccuuguugauacccuuaauacgcauuacgaaagcuaauuuagcuuccgcuggaacguagaaguuucccuuguuuuuagcuuggcggaucaaccuaauuucaucucguuccuucagccuguacucuuuaauguauuguucggcccucuugaaaauaucuuuccucuucuugaugugcuc

SEQ ID NO: 1219 - RNA, 352 nt, artificial sequence
  synthetic construct
guaucaucaucaucuucagccauuuccuuggccaauuccaaauccugcugcucccucucccgucuuuccucagccgauuccaguuccuuuccguacgcauucggcggguaucucauggcuuucacgcucugauugugcaaauccaaacaaaaugauauccucugaugaaaggccaauugaggcucuuuaguacaguagauaucaguacucucuuuacuccucauguagcccccuuguggguccaaaguagcuucgauaacaccaucucgaauggccuucgcuacgaugaauuccgcauccuccgcugaauccaggcccaauuucuuagcuauauccugcggagauauccugc

SEQ ID NO: 1220 - RNA, 351 nt, artificial sequence
  synthetic construct
guaucucauggcuuucacgcucugauugugcaaauccaaacaaaaugauauccucugaugaaaggccaauugaggcucuuuaguacaguagauaucaguacucucuuuacuccucauguagcccccuuguggguccaaaguagcuucgauaacaccaucucgaauggccuucgcuacgaugaauuccgcauccuccgcugaauccaggcccaauuucuuagcuauauccugcggagauauccuggaauaagacaaaccaaucgaucuaauagcugucuugauaacauuaugccgaagccgcaggaucaaaguaaacguaugaucuacccuaaauugcggcccaaaauucuc

SEQ ID NO: 1221 - RNA, 352 nt, artificial sequence
  synthetic construct
gugauugugcaaauccaaacaaaaugauauccucugaugaaaggccaauugaggcucuuuaguacaguagauaucaguacucucuuuacuccucauguagcccccuuguggguccaaaguagcuucgauaacaccaucucgaauggccuucgcuacgaugaauuccgcauccuccgcugaauccaggcccaauuucuuagcuauauccugcggagauauccuggaauaagacaaaccaaucgaucuaauagcugucuugauaacauuaugccgaagccgcaggaucaaaguaaacguaugaucuacccuaaauugcggcccaaaauucuccaacaccuccccgaaccguugc

SEQ ID NO: 1222 - RNA, 352 nt, artificial sequence
  synthetic construct
gaucaucaucaucuucagccauuuccuuggccaauuccaaauccugcugcucccucucccgucuuuccucagccgauuccaguuccuuuccguacgcauucggcggguaucucauggcuuucacgcucugauugugcaaauccaaacaaaaugauauccucugaugaaaggccaauugaggcucuuuaguacaguagauaucaguacucucuuuacuccucauguagcccccuuguggguccaaaguagcuucgauaacaccaucucgaauggccuucgcuacgaugaauuccgcauccuccgcugaauccaggcccaauuucuuagcuauauccugcggagauauccuggc

SEQ ID NO: 1223 - RNA, 351 nt, artificial sequence
  synthetic construct
gaacuaucaucaucaucuucagccauuuccuuggccaauuccaaauccugcugcucccucucccgucuuuccucagccgauuccaguuccuuuccguacgcauucggcggguaucucauggcuuucacgcucugauugugcaaauccaaacaaaaugauauccucugaugaaaggccaauugaggcucuuuaguacaguagauaucaguacucucuuuacuccucauguagcccccuuguggguccaaaguagcuucgauaacaccaucucgaauggccuucgcuacgaugaauuccgcauccuccgcugaauccaggcccaauuucuuagcuauauccugcggagauauc

SEQ ID NO: 1224 - RNA, 350 nt, artificial sequence
  synthetic construct
gcaacaaauugaaaauauccugcaauugauagaugaucugaugauugaugggcaguuuguuaucgcacacuugcaucaaauagucucuuauaucucucaauugcaaaugcaacccuuuaaggccuaauaacugauuaguaauccuuugagauaaaguucccacuguagugucuuuaauaucucuuaguaaauguucuacuccgacuuccucagcuucuucugcgccuauuucgcucgggacguguucaaacguuuuagauguaggagagccaucaucauggaccucuucuaccgcuugguaugcuucaguaggaagccccagaucuuuagguuucgcaucuauaaucacc

SEQ ID NO: 1225 - RNA, 351 nt, artificial sequence
  synthetic construct
gucuucugcgucucuguuggugaguuuguuguugauuagguugugcaaugcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauaucucucaauugcaaaugcaacccuuuaaggccuaauaacugauuaguaauccuuugagauaaaguucccacuguagugucuuuaauaucucuuaguaaauguucuacucc

SEQ ID NO: 1226 - RNA, 351 nt, artificial sequence
  synthetic construct
guauuuuuucuucucguccuucuucgcuuccuucucuuuguccguuuuuuccuuauccuugucuuugcuaucuuuauccuuguuguccuuuuucucuuccuuuuugccuucuucugcgucucuguuggugaguuuguuguugauuagguugugcaaugcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauauc

SEQ ID NO: 1227 - RNA, 352 nt, artificial sequence
  synthetic construct
guuucuucucguccuucuucgcuuccuucucuuuguccguuuuuuccuuauccuugucuuugcuaucuuuauccuuguuguccuuuuucucuuccuuuuugccuucuucugcgucucuguuggugaguuuguuguugauuagguugugcaaugcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauaucucucac

SEQ ID NO: 1228 - RNA, 352 nt, artificial sequence
  synthetic construct
guauccuugucuuugcuaucuuuauccuuguuguccuuuuucucuuccuuuuugccuucuucugcgucucuguuggugaguuuguuguugauuagguugugcaaugcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauaucucucaauugcaaaugcaacccuuuaaggccuaauaacugauuaguaauccuuc

SEQ ID NO: 1229 - RNA, 351 nt, artificial sequence
  synthetic construct
guuuuucucuuccuuuuugccuucuucugcgucucuguuggugaguuuguuguugauuagguugugcaaugcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauaucucucaauugcaaaugcaacccuuuaaggccuaauaacugauuaguaauccuuugagauaaaguucccacuguagugucuuuaauauc

SEQ ID NO: 1230 - RNA, 352 nt, artificial sequence
  synthetic construct
guucuucucguccuucuucgcuuccuucucuuuguccguuuuuuccuuauccuugucuuugcuaucuuuauccuuguuguccuuuuucucuuccuuuuugccuucuucugcgucucuguuggugaguuuguuguugauuagguugugcaaugcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauaucucucaac

SEQ ID NO: 1231 - RNA, 351 nt, artificial sequence
  synthetic construct
guaucuuuauccuuguuguccuuuuucucuuccuuuuugccuucuucugcgucucuguuggugaguuuguuguugauuagguugugcaaugcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauaucucucaauugcaaaugcaacccuuuaaggccuaauaacugauuaguaauccuuugagauaaaguuccc

SEQ ID NO: 1232 - RNA, 352 nt, artificial sequence
  synthetic construct
guuugcuaucuuuauccuuguuguccuuuuucucuuccuuuuugccuucuucugcgucucuguuggugaguuuguuguugauuagguugugcaaugcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauaucucucaauugcaaaugcaacccuuuaaggccuaauaacugauuaguaauccuuugagauaaagc

SEQ ID NO: 1233 - RNA, 351 nt, artificial sequence
  synthetic construct
gccuuauccuugucuuugcuaucuuuauccuuguuguccuuuuucucuuccuuuuugccuucuucugcgucucuguuggugaguuuguuguugauuagguugugcaaugcaacgauagaucgaacgagagccccuaaauaaacuacaagcauuugaucguuauuuuuaacauaaaacgaauuguugaacgcaucuugauuuauaucgggcaacaaauugaaaauauccugcaauugauagaugaucugaugauugaugggcaguuuguuaucgcacacuugcaucaaauagucucuuauaucucucaauugcaaaugcaacccuuuaaggccuaauaacugauuaguaauc

SEQ ID NO: 1234 - RNA, 351 nt, artificial sequence
  synthetic construct
gacuuugcacaaguuuugggcauccggguugauuuuuacuuuggguucagucuuuucuaggaaagcgaucgcgucuuucgguuccuuguacuguucgacgacaauggccgcuauuucgaccaaagacaaaggauuaauuuuauuuucaaacguuugaauaaaauugugguacagcuggauuagguuguccgcuuucuguaauucugguuucuuuauaaacacuaguaauuugaggguuaguugaugccauaauuuuuuauuauggagcuccucaaguucugcccacucagagcccaauuccuucggacuuucuuuuuguuguuuagcaagauaaucacuaacauuagacgc

SEQ ID NO: 1235 - RNA, 352 nt, artificial sequence
  synthetic construct
gaauaaaaucucccguguacuggaguaaccccguccgcauuaucaaaggucgcuucgaccuccucgaugaucuuuuugguggugucuaaaucguuuaacuuaucaagguagaucuguccuucgaggacuuugcacaaguuuugggcauccggguugauuuuuacuuuggguucagucuuuucuaggaaagcgaucgcgucuuucgguuccuuguacuguucgacgacaauggccgcuauuucgaccaaagacaaaggauuaauuuuauuuucaaacguuugaauaaaauugugguacagcuggauuagguuguccgcuuucuguaauucugguuucuuuauaaacacuaguc

SEQ ID NO: 1236 - RNA, 351 nt, artificial sequence
  synthetic construct
gauugcgaggcgaguaaauaaaaucucccguguacuggaguaaccccguccgcauuaucaaaggucgcuucgaccuccucgaugaucuuuuugguggugucuaaaucguuuaacuuaucaagguagaucuguccuucgaggacuuugcacaaguuuugggcauccggguugauuuuuacuuuggguucagucuuuucuaggaaagcgaucgcgucuuucgguuccuuguacuguucgacgacaauggccgcuauuucgaccaaagacaaaggauuaauuuuauuuucaaacguuugaauaaaauugugguacagcuggauuagguuguccgcuuucuguaauucugguuuc

SEQ ID NO: 1237 - RNA, 351 nt, artificial sequence
  synthetic construct
gaacgauuccacaucuaugcagcccaaauaccucaaagcagugcgauaauauugcgcauggucuccuugaauucuguaauauugcgaggcgaguaaauaaaaucucccguguacuggaguaaccccguccgcauuaucaaaggucgcuucgaccuccucgaugaucuuuuugguggugucuaaaucguuuaacuuaucaagguagaucuguccuucgaggacuuugcacaaguuuugggcauccggguugauuuuuacuuuggguucagucuuuucuaggaaagcgaucgcgucuuucgguuccuuguacuguucgacgacaauggccgcuauuucgaccaaagacaaagc

SEQ ID NO: 1238 - RNA, 350 nt, artificial sequence
  synthetic construct
ggacuuugcacaaguuuugggcauccggguugauuuuuacuuuggguucagucuuuucuaggaaagcgaucgcgucuuucgguuccuuguacuguucgacgacaauggccgcuauuucgaccaaagacaaaggauuaauuuuauuuucaaacguuugaauaaaauugugguacagcuggauuagguuguccgcuuucuguaauucugguuucuuuauaaacacuaguaauuugaggguuaguugaugccauaauuuuuuauuauggagcuccucaaguucugcccacucagagcccaauuccuucggacuuucuuuuuguuguuuagcaagauaaucacuaacauuagac

SEQ ID NO: 1239 - RNA, 352 nt, artificial sequence
  synthetic construct
gacuuugcacaaguuuugggcauccggguugauuuuuacuuuggguucagucuuuucuaggaaagcgaucgcgucuuucgguuccuuguacuguucgacgacaauggccgcuauuucgaccaaagacaaaggauuaauuuuauuuucaaacguuugaauaaaauugugguacagcuggauuagguuguccgcuuucuguaauucugguuucuuuauaaacacuaguaauuugaggguuaguugaugccauaauuuuuuauuauggagcuccucaaguucugcccacucagagcccaauuccuucggacuuucuuuuuguuguuuagcaagauaaucacuaacauuagacggc

SEQ ID NO: 1240 - RNA, 352 nt, artificial sequence
  synthetic construct
guuuugguggugucuaaaucguuuaacuuaucaagguagaucuguccuucgaggacuuugcacaaguuuugggcauccggguugauuuuuacuuuggguucagucuuuucuaggaaagcgaucgcgucuuucgguuccuuguacuguucgacgacaauggccgcuauuucgaccaaagacaaaggauuaauuuuauuuucaaacguuugaauaaaauugugguacagcuggauuagguuguccgcuuucuguaauucugguuucuuuauaaacacuaguaauuugaggguuaguugaugccauaauuuuuuauuauggagcuccucaaguucugcccacucagagcccaauc

SEQ ID NO: 1241 - RNA, 352 nt, artificial sequence
  synthetic construct
gaacgauuccacaucuaugcagcccaaauaccucaaagcagugcgauaauauugcgcauggucuccuugaauucuguaauauugcgaggcgaguaaauaaaaucucccguguacuggaguaaccccguccgcauuaucaaaggucgcuucgaccuccucgaugaucuuuuugguggugucuaaaucguuuaacuuaucaagguagaucuguccuucgaggacuuugcacaaguuuugggcauccggguugauuuuuacuuuggguucagucuuuucuaggaaagcgaucgcgucuuucgguuccuuguacuguucgacgacaauggccgcuauuucgaccaaagacaaaggc

SEQ ID NO: 1242 - RNA, 352 nt, artificial sequence
  synthetic construct
gaucguuuaacuuaucaagguagaucuguccuucgaggacuuugcacaaguuuugggcauccggguugauuuuuacuuuggguucagucuuuucuaggaaagcgaucgcgucuuucgguuccuuguacuguucgacgacaauggccgcuauuucgaccaaagacaaaggauuaauuuuauuuucaaacguuugaauaaaauugugguacagcuggauuagguuguccgcuuucuguaauucugguuucuuuauaaacacuaguaauuugaggguuaguugaugccauaauuuuuuauuauggagcuccucaaguucugcccacucagagcccaauuccuucggacuuucuuc

SEQ ID NO: 1243 - RNA, 351 nt, artificial sequence
  synthetic construct
gucaacagcgcgucgagcucccguuugcuuucuccgaaucgagaucuaucguuagcgucgauaaggaauacaauggcgucuacggcugggaaguaguccuuccauacucuucgagccugcgaauggccuccuagaucgaacgugguaaaccucauguucccgauggacaguucuucagaagugggauguaacgugggcaagugcugggcuaaucuaucgucuuuaagcauguguaauaaggugguuuuaccagcguuauccagcccuaaaaacagcaauuucccggacuucuuccauaauccuagguagcccagcacucccgugaaccaaucccauaugaacauuucgguc

SEQ ID NO: 1244 - RNA, 352 nt, artificial sequence
  synthetic construct
guuuauugccuagaaucagcacggggcaguuggccaggguuucgucugucaacagcgcgucgagcucccguuugcuuucuccgaaucgagaucuaucguuagcgucgauaaggaauacaauggcgucuacggcugggaaguaguccuuccauacucuucgagccugcgaauggccuccuagaucgaacgugguaaaccucauguucccgauggacaguucuucagaagugggauguaacgugggcaagugcugggcuaaucuaucgucuuuaagcauguguaauaaggugguuuuaccagcguuauccagcccuaaaaacagcaauuucccggacuucuuccauaauccuac

SEQ ID NO: 1245 - RNA, 350 nt, artificial sequence
  synthetic construct
guaaucaauguacugcgccagccaacgaaaacccuccccguagcccugccucuucagaaucgagcacauaaacagcuccaacggucuccccggcagauccgaucgagcgacuuuaccuuuaccggucguuuggccguacaacgaguaaacguuucucaacucauccucagacgccgcgucggguaaaucgauuuuauugccuagaaucagcacggggcaguuggccaggguuucgucugucaacagcgcgucgagcucccguuugcuuucuccgaaucgagaucuaucguuagcgucgauaaggaauacaauggcgucuacggcugggaaguaguccuuccauacucuuc

SEQ ID NO: 1246 - RNA, 351 nt, artificial sequence
  synthetic construct
guucucaacucauccucagacgccgcgucggguaaaucgauuuuauugccuagaaucagcacggggcaguuggccaggguuucgucugucaacagcgcgucgagcucccguuugcuuucuccgaaucgagaucuaucguuagcgucgauaaggaauacaauggcgucuacggcugggaaguaguccuuccauacucuucgagccugcgaauggccuccuagaucgaacgugguaaaccucauguucccgauggacaguucuucagaagugggauguaacgugggcaagugcugggcuaaucuaucgucuuuaagcauguguaauaaggugguuuuaccagcguuauccagc

SEQ ID NO: 1247 - RNA, 352 nt, artificial sequence
  synthetic construct
guuucucaacucauccucagacgccgcgucggguaaaucgauuuuauugccuagaaucagcacggggcaguuggccaggguuucgucugucaacagcgcgucgagcucccguuugcuuucuccgaaucgagaucuaucguuagcgucgauaaggaauacaauggcgucuacggcugggaaguaguccuuccauacucuucgagccugcgaauggccuccuagaucgaacgugguaaaccucauguucccgauggacaguucuucagaagugggauguaacgugggcaagugcugggcuaaucuaucgucuuuaagcauguguaauaaggugguuuuaccagcguuauccagc

SEQ ID NO: 1248 - RNA, 352 nt, artificial sequence
  synthetic construct
guauugccuagaaucagcacggggcaguuggccaggguuucgucugucaacagcgcgucgagcucccguuugcuuucuccgaaucgagaucuaucguuagcgucgauaaggaauacaauggcgucuacggcugggaaguaguccuuccauacucuucgagccugcgaauggccuccuagaucgaacgugguaaaccucauguucccgauggacaguucuucagaagugggauguaacgugggcaagugcugggcuaaucuaucgucuuuaagcauguguaauaaggugguuuuaccagcguuauccagcccuaaaaacagcaauuucccggacuucuuccauaauccuaggc

SEQ ID NO: 1249 - RNA, 352 nt, artificial sequence
  synthetic construct
guucucucaauaguaggaucguucgccaaauucaagaacaaacaaacguucuccaucgaaccguucucuucgaaaucuuguuugaagaaacgagcaguuuccauguugacucccauagcggcgaacacgauggcgaaguugucuucgugaucguccaaagccgacuugccgggcaccuugacaagaccggcuugucuacaaauuugggcggcgauuucguuguggggcagaccagccgccgagaaaaugggaaucuucugaccacgagcgaucgaguucaucacaucgauggcggagauaccgguuuggaucauuuccuccggguagauacgcgaccaaggauugaucgguc

SEQ ID NO: 1250 - RNA, 352 nt, artificial sequence
  synthetic construct
gagcugacggucgacguagaucuguccuucgguaauauaaccggucaaaucgggaaucgggugaguaauaucgucguugggcauagucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaagacguguuucucgcauugauaggccaaaaauucggcugcuguuagagccaaacgaggcgugaugauucucucaauaguaggc

SEQ ID NO: 1251 - RNA, 352 nt, artificial sequence
  synthetic construct
gaauauaaccggucaaaucgggaaucgggugaguaauaucgucguugggcauagucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaagacguguuucucgcauugauaggccaaaaauucggcugcuguuagagccaaacgaggcgugaugauucucucaauaguaggaucguucgccaaauucaagaacaaacaaacguc

SEQ ID NO: 1252 - RNA, 350 nt, artificial sequence
  synthetic construct
ggcguucugagaaugucgccggugaauucacacacgguguuuuuggcgucgauucccgaaguaccuucgaacacuuguacuacggcuuucgagccgcucaccuccaauacuugaccggaucguagacugccaucggccaguuugagcuggacgauuucguugaauuucggaaauuugacaucuucgaggauuaccaacgguccguugacaccagacacuguuuuguaagugagccuuggcugggauacgaagucucuggacacggcuaaaacguguuccugugcggccuguuuugcguuuaacgucgauggguaagacaucuucucugcgugaagaaagauacgucuaac

SEQ ID NO: 1253 - RNA, 352 nt, artificial sequence
  synthetic construct
guagaaacgucagagugaucuuuccuggucauucccucgccgauggcggacuucaugagacgagacagugaugguaagacguuaaucgggggguaaauuugccuguugugcagcugacggucgacguagaucuguccuucgguaauauaaccggucaaaucgggaaucgggugaguaauaucgucguugggcauagucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcgc

SEQ ID NO: 1254 - RNA, 352 nt, artificial sequence
  synthetic construct
guuucucgcauugauaggccaaaaauucggcugcuguuagagccaaacgaggcgugaugauucucucaauaguaggaucguucgccaaauucaagaacaaacaaacguucuccaucgaaccguucucuucgaaaucuuguuugaagaaacgagcaguuuccauguugacucccauagcggcgaacacgauggcgaaguugucuucgugaucguccaaagccgacuugccgggcaccuugacaagaccggcuugucuacaaauuugggcggcgauuucguuguggggcagaccagccgccgagaaaaugggaaucuucugaccacgagcgaucgaguucaucacaucgauggc

SEQ ID NO: 1255 - RNA, 352 nt, artificial sequence
  synthetic construct
guucgaacacuguacgauucucguagcugcccugcgagaugaaguucuucucgaacuuggucaggaacuccagguagagcaaaucgucgggcgucagggccuccucucccaccacggccuucaucgccugaacguccuuaccaauggcguagcaagcguacaacugguuagaaacgucagagugaucuuuccuggucauucccucgccgauggcggacuucaugagacgagacagugaugguaagacguuaaucgggggguaaauuugccuguugugcagcugacggucgacguagaucuguccuucgguaauauaaccggucaaaucgggaaucgggugaguaauaucguc

SEQ ID NO: 1256 - RNA, 350 nt, artificial sequence
  synthetic construct
guaauauaaccggucaaaucgggaaucgggugaguaauaucgucguugggcauagucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaagacguguuucucgcauugauaggccaaaaauucggcugcuguuagagccaaacgaggcgugaugauucucucaauaguaggaucguucgccaaauucaagaacaaacaaac

SEQ ID NO: 1257 - RNA, 352 nt, artificial sequence
  synthetic construct
gcagcugacggucgacguagaucuguccuucgguaauauaaccggucaaaucgggaaucgggugaguaauaucgucguugggcauagucaagauggggauuugggugauggagccguugcggcccuccacacguccggcucguucguaaaugguggccaaaucgguguacauguaaccggggaaaccacgucuaccgggcacuucuucccuggcggcggauaccucacgcaaagcuucagcguacgaagacauaucagucaauaugaccaagacguguuucucgcauugauaggccaaaaauucggcugcuguuagagccaaacgaggcgugaugauucucucaauaguagc

SEQ ID NO: 1258 - RNA, 352 nt, artificial sequence
  synthetic construct
gcuguucaugcucugcauggcuuuggugacaccuuucauggcuugcgccauggcguucugcgaucugagcguuuggauuuuuagcgagacugcuuggauguuggcuuucauuagcaugaauuucuuuacguaucgucugguccugaccaaguccuuggccaugaucuugacggcguccauuugaccuucuuuggcuaauuuuuuaaugucguuuauaaccuucuucucuuguuguuccauuuuuuguuuuucccugucuagaucucgcauggcuuuguuuagcgcucuuugauuuuuucgaagcaauucuucgggggugacuuuuuuaccgaacagccacuccauuuuuaac

SEQ ID NO: 1259 - RNA, 352 nt, artificial sequence
  synthetic construct
guuuaucuaucucaguuugcgccgcuuccuccaucuccucagaguccucgagauccuccauggucucguccagcaucuccucgaugauaccggcuuucaucaucucuuuggacaugucuugcaucgucugcgccaccuccggcacccguacgagccucugcauggucugcaugaccuccguggauuuuugcagcgagcccgacacccugagaguggcuaauugguuuuucauuugcaacauuacggaauugaggugggcuuuggacguguagaucuuguugauggcuuugcgagaguuuaugauuucuuuggcgaguauuaggcagguguccuugucguuuuucuuggcugc

SEQ ID NO: 1260 - RNA, 352 nt, artificial sequence
  synthetic construct
guaucuaucucaguuugcgccgcuuccuccaucuccucagaguccucgagauccuccauggucucguccagcaucuccucgaugauaccggcuuucaucaucucuuuggacaugucuugcaucgucugcgccaccuccggcacccguacgagccucugcauggucugcaugaccuccguggauuuuugcagcgagcccgacacccugagaguggcuaauugguuuuucauuugcaacauuacggaauugaggugggcuuuggacguguagaucuuguugauggcuuugcgagaguuuaugauuucuuuggcgaguauuaggcagguguccuugucguuuuucuuggcugcuc

SEQ ID NO: 1261 - RNA, 352 nt, artificial sequence
  synthetic construct
guuucaucaucucuuuggacaugucuugcaucgucugcgccaccuccggcacccguacgagccucugcauggucugcaugaccuccguggauuuuugcagcgagcccgacacccugagaguggcuaauugguuuuucauuugcaacauuacggaauugaggugggcuuuggacguguagaucuuguugauggcuuugcgagaguuuaugauuucuuuggcgaguauuaggcagguguccuugucguuuuucuuggcugcuuccuuuagggaucgcuugacuuuuucuuccucucgcuguauggaucguauuugccuuuccaguugguagccuucuuugcgcaguuugugguc

SEQ ID NO: 1262 - RNA, 351 nt, artificial sequence
  synthetic construct
gacaugucuugcaucgucugcgccaccuccggcacccguacgagccucugcauggucugcaugaccuccguggauuuuugcagcgagcccgacacccugagaguggcuaauugguuuuucauuugcaacauuacggaauugaggugggcuuuggacguguagaucuuguugauggcuuugcgagaguuuaugauuucuuuggcgaguauuaggcagguguccuugucguuuuucuuggcugcuuccuuuagggaucgcuugacuuuuucuuccucucgcuguauggaucguauuugccuuuccaguugguagccuucuuugcgcaguuugugguuccacucuguaaccaac

SEQ ID NO: 1263 - RNA, 352 nt, artificial sequence
  synthetic construct
gaaucuccucuucguucuccuccuccucgggcuccuccaccgacgucgccggcaccggagacaccuucucggcgggcuccugcggcggcauuggagccuccccaaucuucccuuccguuaucucgaauagcacuuuaucuaucucaguuugcgccgcuuccuccaucuccucagaguccucgagauccuccauggucucguccagcaucuccucgaugauaccggcuuucaucaucucuuuggacaugucuugcaucgucugcgccaccuccggcacccguacgagccucugcauggucugcaugaccuccguggauuuuugcagcgagcccgacacccugagaguggcuac

SEQ ID NO: 1264 - RNA, 351 nt, artificial sequence
  synthetic construct
guuaucuaucucaguuugcgccgcuuccuccaucuccucagaguccucgagauccuccauggucucguccagcaucuccucgaugauaccggcuuucaucaucucuuuggacaugucuugcaucgucugcgccaccuccggcacccguacgagccucugcauggucugcaugaccuccguggauuuuugcagcgagcccgacacccugagaguggcuaauugguuuuucauuugcaacauuacggaauugaggugggcuuuggacguguagaucuuguugauggcuuugcgagaguuuaugauuucuuuggcgaguauuaggcagguguccuugucguuuuucuuggcugc

SEQ ID NO: 1265 - RNA, 352 nt, artificial sequence
  synthetic construct
guucaucaucucuuuggacaugucuugcaucgucugcgccaccuccggcacccguacgagccucugcauggucugcaugaccuccguggauuuuugcagcgagcccgacacccugagaguggcuaauugguuuuucauuugcaacauuacggaauugaggugggcuuuggacguguagaucuuguugauggcuuugcgagaguuuaugauuucuuuggcgaguauuaggcagguguccuugucguuuuucuuggcugcuuccuuuagggaucgcuugacuuuuucuuccucucgcuguauggaucguauuugccuuuccaguugguagccuucuuugcgcaguuugugguuc

SEQ ID NO: 1266 - RNA, 352 nt, artificial sequence
  synthetic construct
guuucccuuaucaucuuuaauaguaauaggucugucuucuuuaauucuuucuagggcagccgggcaaucaagccuauauuucuuaacaaaagcaucaacaguaggaaacucaucuccauuaacuugucugaaugcugcuuuguauugaacuaguagcuuacuacaagcaccaguauauucuuuggcaacaacacaaucccuaauguacgccuuuucaagcuguugcaauguguugauaacugcguagagaucugcuaaauuaucguauuuuucccuuucccuugcauugugauauaguuuuacuucuucguaaagcucuggacgauuuucgugauuagcagacauuauaaac

SEQ ID NO: 1267 - RNA, 351 nt, artificial sequence
  synthetic construct
gauagggacacaauaucagcaauacaucuacuaguauuucccuuaucaucuuuaauaguaauaggucugucuucuuuaauucuuucuagggcagccgggcaaucaagccuauauuucuuaacaaaagcaucaacaguaggaaacucaucuccauuaacuugucugaaugcugcuuuguauugaacuaguagcuuacuacaagcaccaguauauucuuuggcaacaacacaaucccuaauguacgccuuuucaagcuguugcaauguguugauaacugcguagagaucugcuaaauuaucguauuuuucccuuucccuugcauugugauauaguuuuacuucuucguaaagc

SEQ ID NO: 1268 - RNA, 352 nt, artificial sequence
  synthetic construct
guacaucuacuaguauuucccuuaucaucuuuaauaguaauaggucugucuucuuuaauucuuucuagggcagccgggcaaucaagccuauauuucuuaacaaaagcaucaacaguaggaaacucaucuccauuaacuugucugaaugcugcuuuguauugaacuaguagcuuacuacaagcaccaguauauucuuuggcaacaacacaaucccuaauguacgccuuuucaagcuguugcaauguguugauaacugcguagagaucugcuaaauuaucguauuuuucccuuucccuugcauugugauauaguuuuacuucuucguaaagcucuggacgauuuucgugauuac

SEQ ID NO: 1269 - RNA, 351 nt, artificial sequence
  synthetic construct
gagggacacaauaucagcaauacaucuacuaguauuucccuuaucaucuuuaauaguaauaggucugucuucuuuaauucuuucuagggcagccgggcaaucaagccuauauuucuuaacaaaagcaucaacaguaggaaacucaucuccauuaacuugucugaaugcugcuuuguauugaacuaguagcuuacuacaagcaccaguauauucuuuggcaacaacacaaucccuaauguacgccuuuucaagcuguugcaauguguugauaacugcguagagaucugcuaaauuaucguauuuuucccuuucccuugcauugugauauaguuuuacuucuucguaaagcuc

SEQ ID NO: 1270 - RNA, 352 nt, artificial sequence
  synthetic construct
guaucuaaucucaauuuguccauuacaguaaugaauagggacacaauaucagcaauacaucuacuaguauuucccuuaucaucuuuaauaguaauaggucugucuucuuuaauucuuucuagggcagccgggcaaucaagccuauauuucuuaacaaaagcaucaacaguaggaaacucaucuccauuaacuugucugaaugcugcuuuguauugaacuaguagcuuacuacaagcaccaguauauucuuuggcaacaacacaaucccuaauguacgccuuuucaagcuguugcaauguguugauaacugcguagagaucugcuaaauuaucguauuuuucccuuucccuuc

SEQ ID NO: 1271 - RNA, 352 nt, artificial sequence
  synthetic construct
guaucagcaauacaucuacuaguauuucccuuaucaucuuuaauaguaauaggucugucuucuuuaauucuuucuagggcagccgggcaaucaagccuauauuucuuaacaaaagcaucaacaguaggaaacucaucuccauuaacuugucugaaugcugcuuuguauugaacuaguagcuuacuacaagcaccaguauauucuuuggcaacaacacaaucccuaauguacgccuuuucaagcuguugcaauguguugauaacugcguagagaucugcuaaauuaucguauuuuucccuuucccuugcauugugauauaguuuuacuucuucguaaagcucuggacgauuuc

SEQ ID NO: 1272 - RNA, 351 nt, artificial sequence
  synthetic construct
guuaaaaugcguggcuguuugcacuuuacguacaggcugcaugagagcaucucgaacaacuauacuuauaucugcacccgaauacccuucugucuugcuggcuaauucuuuaauguccucuucggucaauuccguucugguauuacccaaaugcaguuuaaacauuacagcccuggccggcuccuccggcagcgguauguaaauucucuuuucgaaacgucuucgaaucgcagaaucuaauacccacgguauauucguugcuccuaguaccagaaucccuucggugucgugacccacaccuugcauuuggaccaaaaacucgguuuugauccuucuagcagacucagauuc

SEQ ID NO: 1273 - RNA, 351 nt, artificial sequence
  synthetic construct
gugcuggcuaauucuuuaauguccucuucggucaauuccguucugguauuacccaaaugcaguuuaaacauuacagcccuggccggcuccuccggcagcgguauguaaauucucuuuucgaaacgucuucgaaucgcagaaucuaauacccacgguauauucguugcuccuaguaccagaaucccuucggugucgugacccacaccuugcauuuggaccaaaaacucgguuuugauccuucuagcagacucagauucguuaucggaacgugaagaacagagcgaaucgaucucaucgaugaagaugaugcugggcuugugcgcucgggccaauucgaacagauucuucacc

SEQ ID NO: 1274 - RNA, 352 nt, artificial sequence
  synthetic construct
guauacuuauaucugcacccgaauacccuucugucuugcuggcuaauucuuuaauguccucuucggucaauuccguucugguauuacccaaaugcaguuuaaacauuacagcccuggccggcuccuccggcagcgguauguaaauucucuuuucgaaacgucuucgaaucgcagaaucuaauacccacgguauauucguugcuccuaguaccagaaucccuucggugucgugacccacaccuugcauuuggaccaaaaacucgguuuugauccuucuagcagacucagauucguuaucggaacgugaagaacagagcgaaucgaucucaucgaugaagaugaugcugggcuc

SEQ ID NO: 1275 - RNA, 351 nt, artificial sequence
  synthetic construct
guaucaacaaaucgucaacaaucguuuuuggaucagucggagaagguccccuaacuuucuuaaaaugcguggcuguuugcacuuuacguacaggcugcaugagagcaucucgaacaacuauacuuauaucugcacccgaauacccuucugucuugcuggcuaauucuuuaauguccucuucggucaauuccguucugguauuacccaaaugcaguuuaaacauuacagcccuggccggcuccuccggcagcgguauguaaauucucuuuucgaaacgucuucgaaucgcagaaucuaauacccacgguauauucguugcuccuaguaccagaaucccuucggugucgugac

SEQ ID NO: 1276 - RNA, 351 nt, artificial sequence
  synthetic construct
guuaacauaucauucagaguaacgggcggcucggcuaacuuaucacucgguauauccauccaggacauuucuauagcaccaggaucaccuggcgaacacgguaucaacaaaucgucaacaaucguuuuuggaucagucggagaagguccccuaacuuucuuaaaaugcguggcuguuugcacuuuacguacaggcugcaugagagcaucucgaacaacuauacuuauaucugcacccgaauacccuucugucuugcuggcuaauucuuuaauguccucuucggucaauuccguucugguauuacccaaaugcaguuuaaacauuacagcccuggccggcuccuccggcagc

SEQ ID NO: 1277 - RNA, 351 nt, artificial sequence
  synthetic construct
gcaggaucaccuggcgaacacgguaucaacaaaucgucaacaaucguuuuuggaucagucggagaagguccccuaacuuucuuaaaaugcguggcuguuugcacuuuacguacaggcugcaugagagcaucucgaacaacuauacuuauaucugcacccgaauacccuucugucuugcuggcuaauucuuuaauguccucuucggucaauuccguucugguauuacccaaaugcaguuuaaacauuacagcccuggccggcuccuccggcagcgguauguaaauucucuuuucgaaacgucuucgaaucgcagaaucuaauacccacgguauauucguugcuccuaguacc

SEQ ID NO: 1278 - RNA, 352 nt, artificial sequence
  synthetic construct
guaucauucagaguaacgggcggcucggcuaacuuaucacucgguauauccauccaggacauuucuauagcaccaggaucaccuggcgaacacgguaucaacaaaucgucaacaaucguuuuuggaucagucggagaagguccccuaacuuucuuaaaaugcguggcuguuugcacuuuacguacaggcugcaugagagcaucucgaacaacuauacuuauaucugcacccgaauacccuucugucuugcuggcuaauucuuuaauguccucuucggucaauuccguucugguauuacccaaaugcaguuuaaacauuacagcccuggccggcuccuccggcagcgguaugc

SEQ ID NO: 1279 - RNA, 352 nt, artificial sequence
  synthetic construct
gucggucaauuccguucugguauuacccaaaugcaguuuaaacauuacagcccuggccggcuccuccggcagcgguauguaaauucucuuuucgaaacgucuucgaaucgcagaaucuaauacccacgguauauucguugcuccuaguaccagaaucccuucggugucgugacccacaccuugcauuuggaccaaaaacucgguuuugauccuucuagcagacucagauucguuaucggaacgugaagaacagagcgaaucgaucucaucgaugaagaugaugcugggcuugugcgcucgggccaauucgaacagauucuucaccagcuucucggauucacccagccauuuc

SEQ ID NO: 1280 - RNA, 351 nt, artificial sequence
  synthetic construct
gccaggaucaccuggcgaacacgguaucaacaaaucgucaacaaucguuuuuggaucagucggagaagguccccuaacuuucuuaaaaugcguggcuguuugcacuuuacguacaggcugcaugagagcaucucgaacaacuauacuuauaucugcacccgaauacccuucugucuugcuggcuaauucuuuaauguccucuucggucaauuccguucugguauuacccaaaugcaguuuaaacauuacagcccuggccggcuccuccggcagcgguauguaaauucucuuuucgaaacgucuucgaaucgcagaaucuaauacccacgguauauucguugcuccuaguac

SEQ ID NO: 1281 - RNA, 352 nt, artificial sequence
  synthetic construct
guuuaauguccucuucggucaauuccguucugguauuacccaaaugcaguuuaaacauuacagcccuggccggcuccuccggcagcgguauguaaauucucuuuucgaaacgucuucgaaucgcagaaucuaauacccacgguauauucguugcuccuaguaccagaaucccuucggugucgugacccacaccuugcauuuggaccaaaaacucgguuuugauccuucuagcagacucagauucguuaucggaacgugaagaacagagcgaaucgaucucaucgaugaagaugaugcugggcuugugcgcucgggccaauucgaacagauucuucaccagcuucucggauuc

SEQ ID NO: 1282 - RNA, 352 nt, artificial sequence
  synthetic construct
guucucaauuuggucagauccucaucauugacuguugguuucgagguggacacagaucuuaacauaucauucagaguaacgggcggcucggcuaacuuaucacucgguauauccauccaggacauuucuauagcaccaggaucaccuggcgaacacgguaucaacaaaucgucaacaaucguuuuuggaucagucggagaagguccccuaacuuucuuaaaaugcguggcuguuugcacuuuacguacaggcugcaugagagcaucucgaacaacuauacuuauaucugcacccgaauacccuucugucuugcuggcuaauucuuuaauguccucuucggucaauuccguuc

SEQ ID NO: 1283 - RNA, 352 nt, artificial sequence
  synthetic construct
guucuaauucauccucguccaaaucaucagcgaagccuaccggcuggcuaauagcaguaguaaucucguuggcaaugucaugcuguucagcuaugucauccaugaugucguggacaucaucgacauucaaguuuuugugggcuuuuuggagagcuucagcugcauucuucauugaaucuaagacggcuguguuggugcuggcuccuucgagggccucccuuugcauuucgauuguagugagugugccaucgauuuguaauugaguuuuuuccaaucguuuuuucuuuuugagcgccugcagcgcgacucucuuauucuuugaugcauuuuuuuuggcuacuaguguauauuc

SEQ ID NO: 1284 - RNA, 351 nt, artificial sequence
  synthetic construct
guaauagcaguaguaaucucguuggcaaugucaugcuguucagcuaugucauccaugaugucguggacaucaucgacauucaaguuuuugugggcuuuuuggagagcuucagcugcauucuucauugaaucuaagacggcuguguuggugcuggcuccuucgagggccucccuuugcauuucgauuguagugagugugccaucgauuuguaauugaguuuuuuccaaucguuuuuucuuuuugagcgccugcagcgcgacucucuuauucuuugaugcauuuuuuuuggcuacuaguguauauuccucuauuuucuuuucuaaaaacucuuguuuuuuauauaacaugucc

SEQ ID NO: 1285 - RNA, 352 nt, artificial sequence
  synthetic construct
gccaagcuuccaauucuuucaugucaucaucauccuccacuuuuuuagcagcagguuuaacgggcuuggcaauagcuccuguagguacagcagguaguucaguugggccuggaacuuucagcaaaucuuccucuaauccuucuuguucgagcuuuucuaguucgcuuucuaauucauccucguccaaaucaucagcgaagccuaccggcuggcuaauagcaguaguaaucucguuggcaaugucaugcuguucagcuaugucauccaugaugucguggacaucaucgacauucaaguuuuugugggcuuuuuggagagcuucagcugcauucuucauugaaucuaagacggc

SEQ ID NO: 1286 - RNA, 352 nt, artificial sequence
  synthetic construct
guaauccuucuuguucgagcuuuucuaguucgcuuucuaauucauccucguccaaaucaucagcgaagccuaccggcuggcuaauagcaguaguaaucucguuggcaaugucaugcuguucagcuaugucauccaugaugucguggacaucaucgacauucaaguuuuugugggcuuuuuggagagcuucagcugcauucuucauugaaucuaagacggcuguguuggugcuggcuccuucgagggccucccuuugcauuucgauuguagugagugugccaucgauuuguaauugaguuuuuuccaaucguuuuuucuuuuugagcgccugcagcgcgacucucuuauucuc

SEQ ID NO: 1287 - RNA, 352 nt, artificial sequence
  synthetic construct
gagcaguaguaaucucguuggcaaugucaugcuguucagcuaugucauccaugaugucguggacaucaucgacauucaaguuuuugugggcuuuuuggagagcuucagcugcauucuucauugaaucuaagacggcuguguuggugcuggcuccuucgagggccucccuuugcauuucgauuguagugagugugccaucgauuuguaauugaguuuuuuccaaucguuuuuucuuuuugagcgccugcagcgcgacucucuuauucuuugaugcauuuuuuuuggcuacuaguguauauuccucuauuuucuuuucuaaaaacucuuguuuuuuauauaacauguccucggc

SEQ ID NO: 1288 - RNA, 351 nt, artificial sequence
  synthetic construct
guucaugucaucaucauccuccacuuuuuuagcagcagguuuaacgggcuuggcaauagcuccuguagguacagcagguaguucaguugggccuggaacuuucagcaaaucuuccucuaauccuucuuguucgagcuuuucuaguucgcuuucuaauucauccucguccaaaucaucagcgaagccuaccggcuggcuaauagcaguaguaaucucguuggcaaugucaugcuguucagcuaugucauccaugaugucguggacaucaucgacauucaaguuuuugugggcuuuuuggagagcuucagcugcauucuucauugaaucuaagacggcuguguuggugcuggc

SEQ ID NO: 1289 - RNA, 352 nt, artificial sequence
  synthetic construct
gugggcuuuuuggagagcuucagcugcauucuucauugaaucuaagacggcuguguuggugcuggcuccuucgagggccucccuuugcauuucgauuguagugagugugccaucgauuuguaauugaguuuuuuccaaucguuuuuucuuuuugagcgccugcagcgcgacucucuuauucuuugaugcauuuuuuuuggcuacuaguguauauuccucuauuuucuuuucuaaaaacucuuguuuuuuauauaacauguccucgguuucccugagcuuuuggauggcuucgccuggcguggggcccacauccuuuucuuuuccuccgaauauuuuacuaaagaaacucauc

SEQ ID NO: 1290 - RNA, 352 nt, artificial sequence
  synthetic construct
guuucuaauucauccucguccaaaucaucagcgaagccuaccggcuggcuaauagcaguaguaaucucguuggcaaugucaugcuguucagcuaugucauccaugaugucguggacaucaucgacauucaaguuuuugugggcuuuuuggagagcuucagcugcauucuucauugaaucuaagacggcuguguuggugcuggcuccuucgagggccucccuuugcauuucgauuguagugagugugccaucgauuuguaauugaguuuuuuccaaucguuuuuucuuuuugagcgccugcagcgcgacucucuuauucuuugaugcauuuuuuuuggcuacuaguguauauc

SEQ ID NO: 1291 - RNA, 352 nt, artificial sequence
  synthetic construct
guuucagcaaaucuuccucuaauccuucuuguucgagcuuuucuaguucgcuuucuaauucauccucguccaaaucaucagcgaagccuaccggcuggcuaauagcaguaguaaucucguuggcaaugucaugcuguucagcuaugucauccaugaugucguggacaucaucgacauucaaguuuuugugggcuuuuuggagagcuucagcugcauucuucauugaaucuaagacggcuguguuggugcuggcuccuucgagggccucccuuugcauuucgauuguagugagugugccaucgauuuguaauugaguuuuuuccaaucguuuuuucuuuuugagcgccugcac

SEQ ID NO: 1292 - RNA, 351 nt, artificial sequence
  synthetic construct
gugugggcuuuuuggagagcuucagcugcauucuucauugaaucuaagacggcuguguuggugcuggcuccuucgagggccucccuuugcauuucgauuguagugagugugccaucgauuuguaauugaguuuuuuccaaucguuuuuucuuuuugagcgccugcagcgcgacucucuuauucuuugaugcauuuuuuuuggcuacuaguguauauuccucuauuuucuuuucuaaaaacucuuguuuuuuauauaacauguccucgguuucccugagcuuuuggauggcuucgccuggcguggggcccacauccuuuucuuuuccuccgaauauuuuacuaaagaaacuc

SEQ ID NO: 1293 - RNA, 351 nt, artificial sequence
  synthetic construct
guucuuucaugucaucaucauccuccacuuuuuuagcagcagguuuaacgggcuuggcaauagcuccuguagguacagcagguaguucaguugggccuggaacuuucagcaaaucuuccucuaauccuucuuguucgagcuuuucuaguucgcuuucuaauucauccucguccaaaucaucagcgaagccuaccggcuggcuaauagcaguaguaaucucguuggcaaugucaugcuguucagcuaugucauccaugaugucguggacaucaucgacauucaaguuuuugugggcuuuuuggagagcuucagcugcauucuucauugaaucuaagacggcuguguuggugc

SEQ ID NO: 1294 - RNA, 253 nt, artificial sequence
  synthetic construct
gauuauagcacgucuaucggcuucgaaagccaggauuucgcacaugcugucagcaguggugccuccgauuuccuugcagaaggugaagaaagccuccaaguaggcuuuguacagaguguuccugaugauuucgauguucaucucguccaaaucuugcucgcugaugcaaucgacgaagaaaggagcuagcggagugucuacuaacaccgcguuguacaauuccgcuggaguggcugcuacguggauggcuucc

SEQ ID NO: 1295 - RNA, 260 nt, artificial sequence
  synthetic construct
guuaucgaucauguaacuguaggugaugaaguccaggaauguggacagggguucuacggcuugguuacgcauaugcuggaacucgaugacgaguuuuucccucaauuugucgucgaugguggauacugacaauggggaggguucguuggccaggaacgugccguagucugugccuuguaaaugcagcuucaaaucuuccagaguuucgcauugcacuaaauugagguaaucggcuugcuucaauaugccgcauuugaagc

SEQ ID NO: 1296 - RNA, 262 nt, artificial sequence
  synthetic construct
gucuuaucucccggauuguuuccagcccccucgaacaauuuggaguacucagcauaauacucggccacagcuuugaccugcucguaauccucagcucuagcuagagcggccaaaccaucaggcuggaguuuuccgcaacgcggguacaacuuagcgcggucaucuuugcucaauuccguuccgaaggaguugauagugaugauuauagcacgucuaucggcuucgaaagccaggauuucgcacaugcugucagcaguggugc

SEQ ID NO: 1297 - RNA, 253 nt, artificial sequence
  synthetic construct
gauuaaaagaauuauguuaucgaucauguaacuguaggugaugaaguccaggaauguggacagggguucuacggcuugguuacgcauaugcuggaacucgaugacgaguuuuucccucaauuugucgucgaugguggauacugacaauggggaggguucguuggccaggaacgugccguagucugugccuuguaaaugcagcuucaaaucuuccagaguuucgcauugcacuaaauugagguaaucggcuugc

SEQ ID NO: 1298 - RNA, 258 nt, artificial sequence
  synthetic construct
gaucuuggcccugugcuucugagccacgcacucugcgauccaaacgauguuccugcauuccugcuccuucagcuucaaauaggaauagaacacaccgaaguggaacuguugcaugaacgcguugauguucaggcgcacuucaugcucgaagaauuuguccuccaacgucuuaucucccggauuguuuccagcccccucgaacaauuuggaguacucagcauaauacucggccacagcuuugaccugcucguaauccuc

SEQ ID NO: 1299 - RNA, 352 nt, artificial sequence
  synthetic construct
gucgauuuucuuggccucacgguacuuuuucaacaaacgacgaaggacucucauacguugaauccauaauucuuuucuugguguucgagcguucgcuguaccuuuccuuuuaccaaaaccgcagugccuacccuuccugcgggcuucgguguucuugcggacacgggcacgugagugcacugcuacaggcuucuugaugaucaaaccaucuuuaaucagcuugcggauguuuugucuugaauuuguauuggcgauuucguugauuucguuaggauccaaccauaccuucuuuuugccgcaucucauaacagaggcugcgagccucuucuggaguuuuaacgaacucauuuuc

SEQ ID NO: 1300 - RNA, 351 nt, artificial sequence
  synthetic construct
gauucugcaaaacuuccugcuucuucguagcgauacguucuucacgucuuucccuggcgcguuugaccuucauucucuuggcguucgccuggucggccaacaucuuggcgcgagccuucucagccuucuucuuguggauguauuccaucaggacacgcuuguucuugaauacguuacccuuugccuucauguacagcgaaugguacagaugucugucgauuuucuuggccucacgguacuuuuucaacaaacgacgaaggacucucauacguugaauccauaauucuuuucuugguguucgagcguucgcuguaccuuuccuuuuaccaaaaccgcagugccuacccuucc

SEQ ID NO: 1301 - RNA, 351 nt, artificial sequence
  synthetic construct
guauuuuuuaguagcagcggcagcuucgucuucccucugguaauucugcaaaacuuccugcuucuucguagcgauacguucuucacgucuuucccuggcgcguuugaccuucauucucuuggcguucgccuggucggccaacaucuuggcgcgagccuucucagccuucuucuuguggauguauuccaucaggacacgcuuguucuugaauacguuacccuuugccuucauguacagcgaaugguacagaugucugucgauuuucuuggccucacgguacuuuuucaacaaacgacgaaggacucucauacguugaauccauaauucuuuucuugguguucgagcguucgc

SEQ ID NO: 1302 - RNA, 352 nt, artificial sequence
  synthetic construct
guuguucuugaauacguuacccuuugccuucauguacagcgaaugguacagaugucugucgauuuucuuggccucacgguacuuuuucaacaaacgacgaaggacucucauacguugaauccauaauucuuuucuugguguucgagcguucgcuguaccuuuccuuuuaccaaaaccgcagugccuacccuuccugcgggcuucgguguucuugcggacacgggcacgugagugcacugcuacaggcuucuugaugaucaaaccaucuuuaaucagcuugcggauguuuugucuugaauuuguauuggcgauuucguugauuucguuaggauccaaccauaccuucuuuuuc

SEQ ID NO: 1303 - RNA, 351 nt, artificial sequence
  synthetic construct
guuacccuuugccuucauguacagcgaaugguacagaugucugucgauuuucuuggccucacgguacuuuuucaacaaacgacgaaggacucucauacguugaauccauaauucuuuucuugguguucgagcguucgcuguaccuuuccuuuuaccaaaaccgcagugccuacccuuccugcgggcuucgguguucuugcggacacgggcacgugagugcacugcuacaggcuucuugaugaucaaaccaucuuuaaucagcuugcggauguuuugucuugaauuuguauuggcgauuucguugauuucguuaggauccaaccauaccuucuuuuugccgcaucucauaac

SEQ ID NO: 1304 - RNA, 352 nt, artificial sequence
  synthetic construct
guuccuuaacucuaucuuucuuaagaggucccauaaacgcagccuugucggcggcgguuuggaaucuaccguguccgaauuuggacgacguaucgaugaauuucaaauugaucuucuccaaagcaauacgcuuagugugaaccaagagagauuuucucaguguaaugacacgcuucuuaggucccauacaacaacccuuaaucaugacgaagucauuguuaacuucaccauaaugagggaaaccacccauugguguaauggucuucucacuaagaucguaaucgguagcagcauuguuuuugaugaccuuuccguccuuagugugaauuccagcaccgauucuguagauuuc

SEQ ID NO: 1305 - RNA, 351 nt, artificial sequence
  synthetic construct
gcuucguaugccaacgagauguaacaccuuuguauccaugaccuuugguuacaccgaugcaaucgaucaucucaucuugagcgaaaacguugccaacgggaaugggcuucuccaaaugcuccuuagcccaugcgacuuugucggcaaugguaccuccguugaguugaauuuccauaauaugggcuuucuuuugacguuguuucaacaauuucaucugagugugagcgaugacucugacaaccuugcaguauuugacgauuuucuucaagucgcgcucaauggacuucuuacccaaaucaucgguccauuucuuggacgccuuggugaaagccuucuucuugcucuuguacc

SEQ ID NO: 1306 - RNA, 352 nt, artificial sequence
  synthetic construct
guuucaaauugaucuucuccaaagcaauacgcuuagugugaaccaagagagauuuucucaguguaaugacacgcuucuuaggucccauacaacaacccuuaaucaugacgaagucauuguuaacuucaccauaaugagggaaaccacccauugguguaauggucuucucacuaagaucguaaucgguagcagcauuguuuuugaugaccuuuccguccuuagugugaauuccagcaccgauucuguagauuuucuuguucaucuccguccugugaugguaacccuuuugaccagcacgagcgacagugaaugacacucgagaaggaugccaggcuccaauacaggcgacuuc

SEQ ID NO: 1307 - RNA, 351 nt, artificial sequence
  synthetic construct
guaacucgaagcagcagcugcagcuggggccgcagucuugucuucuuccuuaacucuaucuuucuuaagaggucccauaaacgcagccuugucggcggcgguuuggaaucuaccguguccgaauuuggacgacguaucgaugaauuucaaauugaucuucuccaaagcaauacgcuuagugugaaccaagagagauuuucucaguguaaugacacgcuucuuaggucccauacaacaacccuuaaucaugacgaagucauuguuaacuucaccauaaugagggaaaccacccauugguguaauggucuucucacuaagaucguaaucgguagcagcauuguuuuugaugac

SEQ ID NO: 1308 - RNA, 352 nt, artificial sequence
  synthetic construct
guugucuucuuccuuaacucuaucuuucuuaagaggucccauaaacgcagccuugucggcggcgguuuggaaucuaccguguccgaauuuggacgacguaucgaugaauuucaaauugaucuucuccaaagcaauacgcuuagugugaaccaagagagauuuucucaguguaaugacacgcuucuuaggucccauacaacaacccuuaaucaugacgaagucauuguuaacuucaccauaaugagggaaaccacccauugguguaauggucuucucacuaagaucguaaucgguagcagcauuguuuuugaugaccuuuccguccuuagugugaauuccagcaccgauucuc

SEQ ID NO: 1309 - RNA, 352 nt, artificial sequence
  synthetic construct
gcguugaacuagcugaacaguaggaauugguucuuuguaaaccagguaauacuguugggccauuuuacgugcuugcuugaccaacaaacgguagucaggucccaucccggaauagaccauuccgaugugcuucgugaucauuucuacuuuauggacgcuguguucgucguaaagaauggauuugugcuuguuuucuguggcuauuaccacuccauuugaugcuuuuauuccuacugaaggagcaccagccgccacugccgcuaaagcauauucgauuuggacuaguuuaccugaagggcugaaaguuguuaaagaaaaacuauaacguucagaugacauuuucacaaaugac

SEQ ID NO: 1310 - RNA, 352 nt, artificial sequence
  synthetic construct
gauuccugcauuacaguugcaacacguugaacuagcugaacaguaggaauugguucuuuguaaaccagguaauacuguugggccauuuuacgugcuugcuugaccaacaaacgguagucaggucccaucccggaauagaccauuccgaugugcuucgugaucauuucuacuuuauggacgcuguguucgucguaaagaauggauuugugcuuguuuucuguggcuauuaccacuccauuugaugcuuuuauuccuacugaaggagcaccagccgccacugccgcuaaagcauauucgauuuggacuaguuuaccugaagggcugaaaguuguuaaagaaaaacuauaacguc

SEQ ID NO: 1311 - RNA, 352 nt, artificial sequence
  synthetic construct
gcaacacguugaacuagcugaacaguaggaauugguucuuuguaaaccagguaauacuguugggccauuuuacgugcuugcuugaccaacaaacgguagucaggucccaucccggaauagaccauuccgaugugcuucgugaucauuucuacuuuauggacgcuguguucgucguaaagaauggauuugugcuuguuuucuguggcuauuaccacuccauuugaugcuuuuauuccuacugaaggagcaccagccgccacugccgcuaaagcauauucgauuuggacuaguuuaccugaagggcugaaaguuguuaaagaaaaacuauaacguucagaugacauuuucacac

SEQ ID NO: 1312 - RNA, 352 nt, artificial sequence
  synthetic construct
gugcaacacguugaacuagcugaacaguaggaauugguucuuuguaaaccagguaauacuguugggccauuuuacgugcuugcuugaccaacaaacgguagucaggucccaucccggaauagaccauuccgaugugcuucgugaucauuucuacuuuauggacgcuguguucgucguaaagaauggauuugugcuuguuuucuguggcuauuaccacuccauuugaugcuuuuauuccuacugaaggagcaccagccgccacugccgcuaaagcauauucgauuuggacuaguuuaccugaagggcugaaaguuguuaaagaaaaacuauaacguucagaugacauuuucac

SEQ ID NO: 1313 - RNA, 350 nt, artificial sequence
  synthetic construct
gcaagcgccacccauuuucuccuuuuccuccacaaacuuguaaugcaaguccaugcaaucauuaucaucgaugugcacccaaccagucucuuucaugugguacacucuaacaauaccuccugaauaggcgucucuaugaguagcgugguaaaucgaucuacgaccuaaaucauaagcuuccucaucggauaagucccauuuguauccagaaucaagcaccccgaaagcguaaauggaaccugaaccuacgcugaacacuuucccggcuguccuuagaccuucugaaucgacguaguagaguugaggaccccuuuugucccauccagccaacaucauucccauggacaaac

SEQ ID NO: 1314 - RNA, 351 nt, artificial sequence
  synthetic construct
gcuccugaauaggcgucucuaugaguagcgugguaaaucgaucuacgaccuaaaucauaagcuuccucaucggauaagucccauuuguauccagaaucaagcaccccgaaagcguaaauggaaccugaaccuacgcugaacacuuucccggcuguccuuagaccuucugaaucgacguaguagaguugaggaccccuuuugucccauccagccaacaucauucccauggacaaacccauuccuuuguaauuauaaaccauauuggccauuaacuuggaagccgcagccaccgaaauacguucccuguuucucaguucguacagccuacauuguuuagcuaauacucggucc

SEQ ID NO: 1315 - RNA, 351 nt, artificial sequence
  synthetic construct
guuucucaguucguacagccuacauuguuuagcuaauacucggucccaguacguacaaucagccgcgccuccugccauuguagcuagcaaaaaacuguugauuuuuaugauuuuuucuacaguuugugauccaaugaauuggccuccaguggcucgggaauccacugcgaguacuacgccccccuuguacaugaaucccaauguggugguaccguggucgaacuuaauuuugaucucacggccauuaucaucuuuggugaaucuugcaaaguuauugcugggaucaggaaaaggcggaacggccaaguucaugccauugaaauuggugcaauacuucugcagacucucguc

SEQ ID NO: 1316 - RNA, 352 nt, artificial sequence
  synthetic construct
gccugccauuguagcuagcaaaaaacuguugauuuuuaugauuuuuucuacaguuugugauccaaugaauuggccuccaguggcucgggaauccacugcgaguacuacgccccccuuguacaugaaucccaauguggugguaccguggucgaacuuaauuuugaucucacggccauuaucaucuuuggugaaucuugcaaaguuauugcugggaucaggaaaaggcggaacggccaaguucaugccauugaaauuggugcaauacuucugcagacucucgucguaggcgagucgcucguaauccucggaauuguagcuuguaaugcccgauaacgcuucuaaacucaugauc

SEQ ID NO: 1317 - RNA, 352 nt, artificial sequence
  synthetic construct
guaccuccugaauaggcgucucuaugaguagcgugguaaaucgaucuacgaccuaaaucauaagcuuccucaucggauaagucccauuuguauccagaaucaagcaccccgaaagcguaaauggaaccugaaccuacgcugaacacuuucccggcuguccuuagaccuucugaaucgacguaguagaguugaggaccccuuuugucccauccagccaacaucauucccauggacaaacccauuccuuuguaauuauaaaccauauuggccauuaacuuggaagccgcagccaccgaaauacguucccuguuucucaguucguacagccuacauuguuuagcuaauacucggc

SEQ ID NO: 1318 - RNA, 351 nt, artificial sequence
  synthetic construct
gcauucccauggacaaacccauuccuuuguaauuauaaaccauauuggccauuaacuuggaagccgcagccaccgaaauacguucccuguuucucaguucguacagccuacauuguuuagcuaauacucggucccaguacguacaaucagccgcgccuccugccauuguagcuagcaaaaaacuguugauuuuuaugauuuuuucuacaguuugugauccaaugaauuggccuccaguggcucgggaauccacugcgaguacuacgccccccuuguacaugaaucccaauguggugguaccguggucgaacuuaauuuugaucucacggccauuaucaucuuuggugaauc

SEQ ID NO: 1319 - RNA, 352 nt, artificial sequence
  synthetic construct
gcuccugccauuguagcuagcaaaaaacuguugauuuuuaugauuuuuucuacaguuugugauccaaugaauuggccuccaguggcucgggaauccacugcgaguacuacgccccccuuguacaugaaucccaauguggugguaccguggucgaacuuaauuuugaucucacggccauuaucaucuuuggugaaucuugcaaaguuauugcugggaucaggaaaaggcggaacggccaaguucaugccauugaaauuggugcaauacuucugcagacucucgucguaggcgagucgcucguaauccucggaauuguagcuuguaaugcccgauaacgcuucuaaacucaugc

SEQ ID NO: 1320 - RNA, 346 nt, artificial sequence
  synthetic construct
gcacgucccuuugaugauaagcuaugucggcggccucuuccaagcacccggcuuugaugcaguauuugacuuugaugucgucgccgacuuugggcagauauuugagggccuccugccguuuguccugccucaagcaaacguccacgaagggagcguauccgauaggggacuucuucgcuuuggaaaacuuuuccagcucgauccaaucguucugaucggccaggcuguugauuuucaaccaccaauaccuuuuaucgggaauuuugaagucguucuugaacuucucggccaacuuggucuccuucauguccaacaggauccugcaggucucguggacugauuuccc

SEQ ID NO: 1321 - RNA, 352 nt, artificial sequence
  synthetic construct
guggucucgggugacuucgccgaggcgcuugcgggcgucuucuagcacggcccucacguggucuucucucacuuucaacaccuucaaucuggccugguucagcauguuggacgauuggauuuucuucuggagcucgacuuguuucuccuucuucucguaguauuccaugaucuugaggcgcugcuguuggaccaaacggcccuuuucuauguugaacuccuccucggcuuuggcaucgauuucuucggccuucucguuggccucuugcucgaugaaagccaucaugugcuugaucuguuucuggacaucugcgucgcucagagccaucguggaugcgauuucggguauuugc

SEQ ID NO: 1322 - RNA, 352 nt, artificial sequence
  synthetic construct
guacuucuuucucgaacagcugguagaguccuugaaggaugaggcuuucgaugauguggccguacuuucccuggucucgggugacuucgccgaggcgcuugcgggcgucuucuagcacggcccucacguggucuucucucacuuucaacaccuucaaucuggccugguucagcauguuggacgauuggauuuucuucuggagcucgacuuguuucuccuucuucucguaguauuccaugaucuugaggcgcugcuguuggaccaaacggcccuuuucuauguugaacuccuccucggcuuuggcaucgauuucuucggccuucucguuggccucuugcucgaugaaagccac

SEQ ID NO: 1323 - RNA, 351 nt, artificial sequence
  synthetic construct
guuacuucuuucucgaacagcugguagaguccuugaaggaugaggcuuucgaugauguggccguacuuucccuggucucgggugacuucgccgaggcgcuugcgggcgucuucuagcacggcccucacguggucuucucucacuuucaacaccuucaaucuggccugguucagcauguuggacgauuggauuuucuucuggagcucgacuuguuucuccuucuucucguaguauuccaugaucuugaggcgcugcuguuggaccaaacggcccuuuucuauguugaacuccuccucggcuuuggcaucgauuucuucggccuucucguuggccucuugcucgaugaaagcc

SEQ ID NO: 1324 - RNA, 351 nt, artificial sequence
  synthetic construct
gugcacguugcccagaaucgacuugaccagcucccuguccugcgggcgcacccugaccguuacuucuuucucgaacagcugguagaguccuugaaggaugaggcuuucgaugauguggccguacuuucccuggucucgggugacuucgccgaggcgcuugcgggcgucuucuagcacggcccucacguggucuucucucacuuucaacaccuucaaucuggccugguucagcauguuggacgauuggauuuucuucuggagcucgacuuguuucuccuucuucucguaguauuccaugaucuugaggcgcugcuguuggaccaaacggcccuuuucuauguugaacuccuc

SEQ ID NO: 1325 - RNA, 352 nt, artificial sequence
  synthetic construct
guucuuucucgaacagcugguagaguccuugaaggaugaggcuuucgaugauguggccguacuuucccuggucucgggugacuucgccgaggcgcuugcgggcgucuucuagcacggcccucacguggucuucucucacuuucaacaccuucaaucuggccugguucagcauguuggacgauuggauuuucuucuggagcucgacuuguuucuccuucuucucguaguauuccaugaucuugaggcgcugcuguuggaccaaacggcccuuuucuauguugaacuccuccucggcuuuggcaucgauuucuucggccuucucguuggccucuugcucgaugaaagccaucac

SEQ ID NO: 1326 - RNA, 351 nt, artificial sequence
  synthetic construct
guaaucggugaacuuccuguucacguuacgcccgaacaaagcguuacguauuuggggcaccaauugcugcgaaaucaaauccaaucgcgccucgagcguguuguugaucuucacuuuauucuucagcgccagcaaaucgaucccuccgguggucuccugcgacaagugcgacucaucgucgaucuucaagugcaccucuuugcccgugauguccuuguacuugguuugcacguugcccagaaucgacuugaccagcucccuguccugcgggcgcacccugaccguuacuucuuucucgaacagcugguagaguccuugaaggaugaggcuuucgaugauguggccguacuc

SEQ ID NO: 1327 - RNA, 352 nt, artificial sequence
  synthetic construct
guucaagugcaccucuuugcccgugauguccuuguacuugguuugcacguugcccagaaucgacuugaccagcucccuguccugcgggcgcacccugaccguuacuucuuucucgaacagcugguagaguccuugaaggaugaggcuuucgaugauguggccguacuuucccuggucucgggugacuucgccgaggcgcuugcgggcgucuucuagcacggcccucacguggucuucucucacuuucaacaccuucaaucuggccugguucagcauguuggacgauuggauuuucuucuggagcucgacuuguuucuccuucuucucguaguauuccaugaucuugaggcgc

SEQ ID NO: 1328 - RNA, 351 nt, artificial sequence
  synthetic construct
gaaauguugcucaucgaaucccugaucaccguccacgugaucuuguucucagauugagcagucgacuccacggcgugucucgccauaucguacaucccaaucauguucuucaacauacccacgguuuuguagaagggacagaaucuaucguacgaugaguacgaguucuguugcaggaaaucuucuuucaacagcuuggcgauuuccaauguaaucuuaucagcuucagcuaaugaagcuuuuccuaccagcugcacgauuuccguaaggucgucuucuucuugaaggauuucuuuaacuuugguucuuagcgguauaaauucagggaaguuuuugucauagaaaucaucc

SEQ ID NO: 1329 - RNA, 352 nt, artificial sequence
  synthetic construct
guaaucuuaucagcuucagcuaaugaagcuuuuccuaccagcugcacgauuuccguaaggucgucuucuucuugaaggauuucuuuaacuuugguucuuagcgguauaaauucagggaaguuuuugucauagaaaucauccaaagcccucaaauauuuagaguaugaacucagccagucgacagacgggaagugcuuacguugggcaagcuucuuguccaauccccaaaacacuugaacgauaccaagaguagcggaagugacaggaucagagaaaucaccaccaggcggcgacacggcuccuacgaucgaaacagacccuucccuaucgggguuacccaagcacuuaacgc

SEQ ID NO: 1330 - RNA, 352 nt, artificial sequence
  synthetic construct
guuuccaauguaaucuuaucagcuucagcuaaugaagcuuuuccuaccagcugcacgauuuccguaaggucgucuucuucuugaaggauuucuuuaacuuugguucuuagcgguauaaauucagggaaguuuuugucauagaaaucauccaaagcccucaaauauuuagaguaugaacucagccagucgacagacgggaagugcuuacguugggcaagcuucuuguccaauccccaaaacacuugaacgauaccaagaguagcggaagugacaggaucagagaaaucaccaccaggcggcgacacggcuccuacgaucgaaacagacccuucccuaucgggguuacccaagc

SEQ ID NO: 1331 - RNA, 352 nt, artificial sequence
  synthetic construct
gaacuucauacugcucaauugguacaaaauguugcucaucgaaucccugaucaccguccacgugaucuuguucucagauugagcagucgacuccacggcgugucucgccauaucguacaucccaaucauguucuucaacauacccacgguuuuguagaagggacagaaucuaucguacgaugaguacgaguucuguugcaggaaaucuucuuucaacagcuuggcgauuuccaauguaaucuuaucagcuucagcuaaugaagcuuuuccuaccagcugcacgauuuccguaaggucgucuucuucuugaaggauuucuuuaacuuugguucuuagcgguauaaauucaggc

SEQ ID NO: 1332 - RNA, 351 nt, artificial sequence
  synthetic construct
gacgugaucuuguucucagauugagcagucgacuccacggcgugucucgccauaucguacaucccaaucauguucuucaacauacccacgguuuuguagaagggacagaaucuaucguacgaugaguacgaguucuguugcaggaaaucuucuuucaacagcuuggcgauuuccaauguaaucuuaucagcuucagcuaaugaagcuuuuccuaccagcugcacgauuuccguaaggucgucuucuucuugaaggauuucuuuaacuuugguucuuagcgguauaaauucagggaaguuuuugucauagaaaucauccaaagcccucaaauauuuagaguaugaacucagc

SEQ ID NO: 1333 - RNA, 351 nt, artificial sequence
  synthetic construct
gaaaauguugcucaucgaaucccugaucaccguccacgugaucuuguucucagauugagcagucgacuccacggcgugucucgccauaucguacaucccaaucauguucuucaacauacccacgguuuuguagaagggacagaaucuaucguacgaugaguacgaguucuguugcaggaaaucuucuuucaacagcuuggcgauuuccaauguaaucuuaucagcuucagcuaaugaagcuuuuccuaccagcugcacgauuuccguaaggucgucuucuucuugaaggauuucuuuaacuuugguucuuagcgguauaaauucagggaaguuuuugucauagaaaucauc

SEQ ID NO: 1334 - RNA, 351 nt, artificial sequence
  synthetic construct
gucaccggauccuugaacuucauacugcucaauugguacaaaauguugcucaucgaaucccugaucaccguccacgugaucuuguucucagauugagcagucgacuccacggcgugucucgccauaucguacaucccaaucauguucuucaacauacccacgguuuuguagaagggacagaaucuaucguacgaugaguacgaguucuguugcaggaaaucuucuuucaacagcuuggcgauuuccaauguaaucuuaucagcuucagcuaaugaagcuuuuccuaccagcugcacgauuuccguaaggucgucuucuucuugaaggauuucuuuaacuuugguucuuagc

SEQ ID NO: 1335 - RNA, 352 nt, artificial sequence
  synthetic construct
gucauguucuucaacauacccacgguuuuguagaagggacagaaucuaucguacgaugaguacgaguucuguugcaggaaaucuucuuucaacagcuuggcgauuuccaauguaaucuuaucagcuucagcuaaugaagcuuuuccuaccagcugcacgauuuccguaaggucgucuucuucuugaaggauuucuuuaacuuugguucuuagcgguauaaauucagggaaguuuuugucauagaaaucauccaaagcccucaaauauuuagaguaugaacucagccagucgacagacgggaagugcuuacguugggcaagcuucuuguccaauccccaaaacacuugaacgc

SEQ ID NO: 1336 - RNA, 352 nt, artificial sequence
  synthetic construct
guccuugaacuucauacugcucaauugguacaaaauguugcucaucgaaucccugaucaccguccacgugaucuuguucucagauugagcagucgacuccacggcgugucucgccauaucguacaucccaaucauguucuucaacauacccacgguuuuguagaagggacagaaucuaucguacgaugaguacgaguucuguugcaggaaaucuucuuucaacagcuuggcgauuuccaauguaaucuuaucagcuucagcuaaugaagcuuuuccuaccagcugcacgauuuccguaaggucgucuucuucuugaaggauuucuuuaacuuugguucuuagcgguauaaac

SEQ ID NO: 1337 - RNA, 352 nt, artificial sequence
  synthetic construct
gccagucgacagacgggaagugcuuacguugggcaagcuucuuguccaauccccaaaacacuugaacgauaccaagaguagcggaagugacaggaucagagaaaucaccaccaggcggcgacacggcuccuacgaucgaaacagacccuucccuaucgggguuacccaagcacuuaacgcgaccggcgcgcucguagaaagaggccaaucgggcccccaaguaggccggguaaccggaaucggcgggcaucucggccaaacgaccggaaauuucucucaacgccucggcccaacgggacguggaaucggccaucaucgauacgugguaacccaugucucugaaguacucggc

SEQ ID NO: 1338 - RNA, 352 nt, artificial sequence
  synthetic construct
gaccggauccuugaacuucauacugcucaauugguacaaaauguugcucaucgaaucccugaucaccguccacgugaucuuguucucagauugagcagucgacuccacggcgugucucgccauaucguacaucccaaucauguucuucaacauacccacgguuuuguagaagggacagaaucuaucguacgaugaguacgaguucuguugcaggaaaucuucuuucaacagcuuggcgauuuccaauguaaucuuaucagcuucagcuaaugaagcuuuuccuaccagcugcacgauuuccguaaggucgucuucuucuugaaggauuucuuuaacuuugguucuuagcggc

SEQ ID NO: 1339 - RNA, 351 nt, artificial sequence
  synthetic construct
gaucgauguguaugucguucaaaacgacuacauuccuguccgaagcggcgccugucacgucguacacgauguuaccgaauaugauaccauucucggucgaggccacuuucacguuagccuugauauugcagaaauccuucggcgccagaacgaccggcugaggcuucuccaccaacuucaaaucgcccagagucgccaacuccagaguacaauucugcagcgugucgcucguuugguucaccaccaacacguccagcacgauaucguacugauuaacgugcacauacgcuucggaguaaacaggauccgagaaacccgucaacugggcgaucuuguucaauuuacucgagc

SEQ ID NO: 1340 - RNA, 352 nt, artificial sequence
  synthetic construct
guucaaaacgacuacauuccuguccgaagcggcgccugucacgucguacacgauguuaccgaauaugauaccauucucggucgaggccacuuucacguuagccuugauauugcagaaauccuucggcgccagaacgaccggcugaggcuucuccaccaacuucaaaucgcccagagucgccaacuccagaguacaauucugcagcgugucgcucguuugguucaccaccaacacguccagcacgauaucguacugauuaacgugcacauacgcuucggaguaaacaggauccgagaaacccgucaacugggcgaucuuguucaauuuacucgagccgaugguggaguccgac

SEQ ID NO: 1341 - RNA, 351 nt, artificial sequence
  synthetic construct
guaauaucgauguguaugucguucaaaacgacuacauuccuguccgaagcggcgccugucacgucguacacgauguuaccgaauaugauaccauucucggucgaggccacuuucacguuagccuugauauugcagaaauccuucggcgccagaacgaccggcugaggcuucuccaccaacuucaaaucgcccagagucgccaacuccagaguacaauucugcagcgugucgcucguuugguucaccaccaacacguccagcacgauaucguacugauuaacgugcacauacgcuucggaguaaacaggauccgagaaacccgucaacugggcgaucuuguucaauuuacuc

SEQ ID NO: 1342 - RNA, 352 nt, artificial sequence
  synthetic construct
gcucugaugucaggcacuucauguuaguacucuucagcagaugcuccagguacucguugagauccgucagcggcguauugacggucaccuuauucucccauucgaauucagcccacauccucauaaacuccgaaucggugcacgaugccggaacaauguaauccauaauaucgauguguaugucguucaaaacgacuacauuccuguccgaagcggcgccugucacgucguacacgauguuaccgaauaugauaccauucucggucgaggccacuuucacguuagccuugauauugcagaaauccuucggcgccagaacgaccggcugaggcuucuccaccaacuucaaauc

SEQ ID NO: 1343 - RNA, 351 nt, artificial sequence
  synthetic construct
guacauauuggccgccaugaagccgcauugcccgccgagcgccuucucugaugucaggcacuucauguuaguacucuucagcagaugcuccagguacucguugagauccgucagcggcguauugacggucaccuuauucucccauucgaauucagcccacauccucauaaacuccgaaucggugcacgaugccggaacaauguaauccauaauaucgauguguaugucguucaaaacgacuacauuccuguccgaagcggcgccugucacgucguacacgauguuaccgaauaugauaccauucucggucgaggccacuuucacguuagccuugauauugcagaaauccuc

SEQ ID NO: 1344 - RNA, 350 nt, artificial sequence
  synthetic construct
gcaaugguaccuccguugaguugaauuuccauaauaugggcuuucuuuugacguuguuucaacaauuucaucugagugugagcgaugacucugacaaccuugcaguauuugacgauuuucuucaagucgcgcucaauggacuucuuacccaaaucaucgguccauuucuuggacgccuuggugaaagccuucuucuugcucuuguaccaguucuuguagaaacgucuacggcaaucuucggacaaauguucagcccaaacgguggccaaagcucucauaccaugcggaguuucgauguaacccacaacaccuacuacaaucaucggaggaguuuccaaaaugguuacagc

SEQ ID NO: 1345 - RNA, 352 nt, artificial sequence
  synthetic construct
gaauacaggcgacuuuccuaagacccuugugcgucuugcggggcaauuucuucguaugccaacgagauguaacaccuuuguauccaugaccuuugguuacaccgaugcaaucgaucaucucaucuugagcgaaaacguugccaacgggaaugggcuucuccaaaugcuccuuagcccaugcgacuuugucggcaaugguaccuccguugaguugaauuuccauaauaugggcuuucuuuugacguuguuucaacaauuucaucugagugugagcgaugacucugacaaccuugcaguauuugacgauuuucuucaagucgcgcucaauggacuucuuacccaaaucaucggc

SEQ ID NO: 1346 - RNA, 351 nt, artificial sequence
  synthetic construct
guucaacaauuucaucugagugugagcgaugacucugacaaccuugcaguauuugacgauuuucuucaagucgcgcucaauggacuucuuacccaaaucaucgguccauuucuuggacgccuuggugaaagccuucuucuugcucuuguaccaguucuuguagaaacgucuacggcaaucuucggacaaauguucagcccaaacgguggccaaagcucucauaccaugcggaguuucgauguaacccacaacaccuacuacaaucaucggaggaguuuccaaaaugguuacagccucuacgauuuccuucuuguugauuuucgaaccaggccugucugccucacguagcac

SEQ ID NO: 1347 - RNA, 352 nt, artificial sequence
  synthetic construct
guucuuccuuaacucuaucuuucuuaagaggucccauaaacgcagccuugucggcggcgguuuggaaucuaccguguccgaauuuggacgacguaucgaugaauuucaaauugaucuucuccaaagcaauacgcuuagugugaaccaagagagauuuucucaguguaaugacacgcuucuuaggucccauacaacaacccuuaaucaugacgaagucauuguuaacuucaccauaaugagggaaaccacccauugguguaauggucuucucacuaagaucguaaucgguagcagcauuguuuuugaugaccuuuccguccuuagugugaauuccagcaccgauucuguagac

SEQ ID NO: 1348 - RNA, 319 nt, artificial sequence
  synthetic construct
guacaucccuccacggagacgaaguacuaaauguagaguagauucuuuuugaauauuguagucagauaagguucuuccaucuuccaguuguuugccagcgaaaauuaaacguugcugaucuggaggaauacccucuuugucuuggauuuucgccuucacguucucaauaguaucagaugguucaacuucgagggugauaguuuuaccaguaaggguuuuaacgaauauuugcaucccaccacggagacgaagaacuaagugcaauguggacucuuucugaauguuguagucagacaagguucuuccaucuuccaguugc

SEQ ID NO: 1349 - RNA, 256 nt, artificial sequence
  synthetic construct
guagaaguuuuuggcuaggauuccaucuuucuucguuaaccucacaauacaaucguccgauucucccauacgccugauagcuccgcagagagcguagcucuuggaacuuucggucauucuuccgguuaaaggaucaacgucggcgacgcugaguugaaugcuagcgugguccuuagcaugaauaauucuguugcuagcagagcauuuucuugggcaguacaagucgacgguuucaccagcgucguuuuccauguuc

SEQ ID NO: 1350 - RNA, 351 nt, artificial sequence
  synthetic construct
gcguucccuguucaugaucguaccgacacgacccaaauuucuaccuccggugaucauacacaaguuguuggauucaaacuugauguaaucgagaauuuuagacguagcgaucuccaauugaauugugucguuuaccuugaugacaggaucaggguaacggauuguacgaccaucgugggucaccaaaaacggaauuccuuugggaccgguuugaacccucuuaacuuugcaaagcuuguauuuagcuucuucagcaguaauacgguggauagcaaaucuuccuuucacaucauagaugagacggaaaaauucaccaguuuuuucaauggugauaacauccauaaaaccugc

SEQ ID NO: 1351 - RNA, 352 nt, artificial sequence
  synthetic construct
gcaauuacgaauacauuauuuaaccuaguagcaaaggcaugaccguuagcauccuuaauauguacaauaucgaaggauccaggaugacguucccuguucaugaucguaccgacacgacccaaauuucuaccuccggugaucauacacaaguuguuggauucaaacuugauguaaucgagaauuuuagacguagcgaucuccaauugaauugugucguuuaccuugaugacaggaucaggguaacggauuguacgaccaucgugggucaccaaaaacggaauuccuuugggaccgguuugaacccucuuaacuuugcaaagcuuguauuuagcuucuucagcaguaauacggc

SEQ ID NO: 1352 - RNA, 352 nt, artificial sequence
  synthetic construct
gacaucauagaugagacggaaaaauucaccaguuuuuucaauggugauaacauccauaaaaccugcgggguaguuggagucgguccugacuuuuccaucgacuuugauuaaucuuugcauaacuauuuuaguuaccucgcuguuagugagagcauacuucagccuguuucuuaagaaaaucaccaaggguaaugauucucggaguuugugaggaccgguggacgggcggggugcgaauacaccucccaauuuguccaacauccaugcuuucggcgcauuuaaacgcuucaagugcuuuuuagguccccgagccaucuugacuuuaaaaauaugaaagacagagcaggcgugc

SEQ ID NO: 1353 - RNA, 351 nt, artificial sequence
  synthetic construct
gaugaccguuagcauccuuaauauguacaauaucgaaggauccaggaugacguucccuguucaugaucguaccgacacgacccaaauuucuaccuccggugaucauacacaaguuguuggauucaaacuugauguaaucgagaauuuuagacguagcgaucuccaauugaauugugucguuuaccuugaugacaggaucaggguaacggauuguacgaccaucgugggucaccaaaaacggaauuccuuugggaccgguuugaacccucuuaacuuugcaaagcuuguauuuagcuucuucagcaguaauacgguggauagcaaaucuuccuuucacaucauagaugagac

SEQ ID NO: 1354 - RNA, 351 nt, artificial sequence
  synthetic construct
guaguguguuuuugcagcuagccuuuuaucccuuucuucggcaauggauagcuucacaccuuuaccucuuggaagagacacaaaagccuuagcuccuuuaccaauuacgaauacauuauuuaaccuaguagcaaaggcaugaccguuagcauccuuaauauguacaauaucgaaggauccaggaugacguucccuguucaugaucguaccgacacgacccaaauuucuaccuccggugaucauacacaaguuguuggauucaaacuugauguaaucgagaauuuuagacguagcgaucuccaauugaauugugucguuuaccuugaugacaggaucaggguaacggauugc

SEQ ID NO: 1355 - RNA, 351 nt, artificial sequence
  synthetic construct
guucacaucauagaugagacggaaaaauucaccaguuuuuucaauggugauaacauccauaaaaccugcgggguaguuggagucgguccugacuuuuccaucgacuuugauuaaucuuugcauaacuauuuuaguuaccucgcuguuagugagagcauacuucagccuguuucuuaagaaaaucaccaaggguaaugauucucggaguuugugaggaccgguggacgggcggggugcgaauacaccucccaauuuguccaacauccaugcuuucggcgcauuuaaacgcuucaagugcuuuuuagguccccgagccaucuugacuuuaaaaauaugaaagacagagcaggc

SEQ ID NO: 1356 - RNA, 350 nt, artificial sequence
  synthetic construct
gauccaggaugacguucccuguucaugaucguaccgacacgacccaaauuucuaccuccggugaucauacacaaguuguuggauucaaacuugauguaaucgagaauuuuagacguagcgaucuccaauugaauugugucguuuaccuugaugacaggaucaggguaacggauuguacgaccaucgugggucaccaaaaacggaauuccuuugggaccgguuugaacccucuuaacuuugcaaagcuuguauuuagcuucuucagcaguaauacgguggauagcaaaucuuccuuucacaucauagaugagacggaaaaauucaccaguuuuuucaauggugauaacauc

SEQ ID NO: 1357 - RNA, 350 nt, artificial sequence
  synthetic construct
guuccuuuucaucaucgcccuuuggaccgaaugcugcuacagguuccaccaauucuucuucgccagguuucaaauugcgaaccaugauaaucccuccgauagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccucc

SEQ ID NO: 1358 - RNA, 351 nt, artificial sequence
  synthetic construct
gcagguuccaccaauucuucuucgccagguuucaaauugcgaaccaugauaaucccuccgauagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuucgguuuucuuaucgucuuuaucuucguccacaucc

SEQ ID NO: 1359 - RNA, 350 nt, artificial sequence
  synthetic construct
gcugcuacagguuccaccaauucuucuucgccagguuucaaauugcgaaccaugauaaucccuccgauagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuucgguuuucuuaucgucuuuaucuucguc

SEQ ID NO: 1360 - RNA, 351 nt, artificial sequence
  synthetic construct
gccgaaugcugcuacagguuccaccaauucuucuucgccagguuucaaauugcgaaccaugauaaucccuccgauagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuucgguuuucuuaucgucuuuauc

SEQ ID NO: 1361 - RNA, 350 nt, artificial sequence
  synthetic construct
gguuccuuuucaucaucgcccuuuggaccgaaugcugcuacagguuccaccaauucuucuucgccagguuucaaauugcgaaccaugauaaucccuccgauagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuc

SEQ ID NO: 1362 - RNA, 351 nt, artificial sequence
  synthetic construct
gcugcuacagguuccaccaauucuucuucgccagguuucaaauugcgaaccaugauaaucccuccgauagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuucgguuuucuuaucgucuuuaucuucgucc

SEQ ID NO: 1363 - RNA, 352 nt, artificial sequence
  synthetic construct
gugcugcuacagguuccaccaauucuucuucgccagguuucaaauugcgaaccaugauaaucccuccgauagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuucgguuuucuuaucgucuuuaucuucguc

SEQ ID NO: 1364 - RNA, 351 nt, artificial sequence
  synthetic construct
guagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuucgguuuucuuaucgucuuuaucuucguccacauccauuuucucaucgcgauguuuccucucgugaucccuucuccuuugccucgcagcuaugcuc

SEQ ID NO: 1365 - RNA, 351 nt, artificial sequence
  synthetic construct
gaaugcugcuacagguuccaccaauucuucuucgccagguuucaaauugcgaaccaugauaaucccuccgauagaaacauccuucauugcaacguauugcgaguuaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuucgguuuucuuaucgucuuuaucuuc

SEQ ID NO: 1366 - RNA, 352 nt, artificial sequence
  synthetic construct
guaucauuaagcguaaucacuuucaguuguugccucaugguccuggcaggauuuugcaagauuucgaaacuaggcucgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuucgguuuucuuaucgucuuuaucuucguccacauccauuuucucaucgcgauguuuccucucgugaucccuucuccuuugccucgcagcuaugcucaauacggcgguggugacuuucucccuuuccucgc

SEQ ID NO: 1367 - RNA, 351 nt, artificial sequence
  synthetic construct
gcgggcuccuuuuucuucuccuccuuaucaucuuucuuaucuuuuuugucgucgcucgacgacgccgcuuuuuuaucgucgguuuucuuaucaucggacuuuuucuccucuuucuugucuucgguuuucuucucuuucuccuccuuuucgguuuucuuaucgucuuuaucuucguccacauccauuuucucaucgcgauguuuccucucgugaucccuucuccuuugccucgcagcuaugcucaauacggcgguggugacuuucucccuuuccucgcguuucuuuuccuccaugggcgccggguaggcguacaagcucgguuucgcguucgauuugaacuccaauuuaggc

SEQ ID NO: 1368 - RNA, 352 nt, artificial sequence
  synthetic construct
guuuaaucgacauauucuucucugaauccuucugcaugaccuuggccacagccauuucgaaaucuucuuggguuacguguacccuucucucccuuagggcguacaugccugccucaguacacacucccuucacuucggcaccgcuggcaccuggcaucaauucggcgauuuuccucaaauugaucccucuggucaaauucauuuuucucgagugaauuuucaagauguccaaucgggcuuccucguucgguggagggaacucgaucuuccugucaauucugccgggccugaguaaagcgggauccaaaaugucgauucuguuuguagccauuauaacuuuaauguucuucgc

SEQ ID NO: 1369 - RNA, 351 nt, artificial sequence
  synthetic construct
gucgaucuuccugucaauucugccgggccugaguaaagcgggauccaaaaugucgauucuguuuguagccauuauaacuuuaauguucuucguagccucaaauccaucgaguugauucagcaacuccagcauaguucuuugaacuucggaaucgccaccagaaccugauucgauacgagaggauccaauagaaucgauuucauccaugaaaaugaucgaaggggcaugcucccuagccauuacgaacaguucccuuaccauccuagaaccuuccccaaugaauuuuugcaccaacuccgauccugauacucuaauaaacgugcauucuguguggugagcuacagcucuagc

SEQ ID NO: 1370 - RNA, 352 nt, artificial sequence
  synthetic construct
guaaucgacauauucuucucugaauccuucugcaugaccuuggccacagccauuucgaaaucuucuuggguuacguguacccuucucucccuuagggcguacaugccugccucaguacacacucccuucacuucggcaccgcuggcaccuggcaucaauucggcgauuuuccucaaauugaucccucuggucaaauucauuuuucucgagugaauuuucaagauguccaaucgggcuuccucguucgguggagggaacucgaucuuccugucaauucugccgggccugaguaaagcgggauccaaaaugucgauucuguuuguagccauuauaacuuuaauguucuucguac

SEQ ID NO: 1371 - RNA, 350 nt, artificial sequence
  synthetic construct
gccguugaaacuguaacuguacaaaauugguugaaucaugaucaaugauugaguaagaucuucucucaucaacauaugucuauagaacgacguuucaucaggagaauuauugaaaacuugcaagaacugagaccuccuuagaugguacaugaauugcggauagaggcuaaaguuuuggccuaaucugaaugaaccagcaucgucuuuauuguauucuccgaauuuuugacacaaucgaaucagcauucuaucgacccaucucagaacgucgggacucucaucugauucagcucuauaaacagccauucuggccauaauuacagcugcugcuuccugaucaaaaccagcgc

SEQ ID NO: 1372 - RNA, 352 nt, artificial sequence
  synthetic construct
gaucaacauaugucuauagaacgacguuucaucaggagaauuauugaaaacuugcaagaacugagaccuccuuagaugguacaugaauugcggauagaggcuaaaguuuuggccuaaucugaaugaaccagcaucgucuuuauuguauucuccgaauuuuugacacaaucgaaucagcauucuaucgacccaucucagaacgucgggacucucaucugauucagcucuauaaacagccauucuggccauaauuacagcugcugcuuccugaucaaaaccagcgcugaugugguggauauuaguaguggcaucagcccaguuucgagccacuguugucacucuaauucuucuc

SEQ ID NO: 1373 - RNA, 352 nt, artificial sequence
  synthetic construct
guguaacuguacaaaauugguugaaucaugaucaaugauugaguaagaucuucucucaucaacauaugucuauagaacgacguuucaucaggagaauuauugaaaacuugcaagaacugagaccuccuuagaugguacaugaauugcggauagaggcuaaaguuuuggccuaaucugaaugaaccagcaucgucuuuauuguauucuccgaauuuuugacacaaucgaaucagcauucuaucgacccaucucagaacgucgggacucucaucugauucagcucuauaaacagccauucuggccauaauuacagcugcugcuuccugaucaaaaccagcgcugaugugguggc

SEQ ID NO: 1374 - RNA, 352 nt, artificial sequence
  synthetic construct
guugaaacuguaacuguacaaaauugguugaaucaugaucaaugauugaguaagaucuucucucaucaacauaugucuauagaacgacguuucaucaggagaauuauugaaaacuugcaagaacugagaccuccuuagaugguacaugaauugcggauagaggcuaaaguuuuggccuaaucugaaugaaccagcaucgucuuuauuguauucuccgaauuuuugacacaaucgaaucagcauucuaucgacccaucucagaacgucgggacucucaucugauucagcucuauaaacagccauucuggccauaauuacagcugcugcuuccugaucaaaaccagcgcugauc

SEQ ID NO: 1375 - RNA, 351 nt, artificial sequence
  synthetic construct
gugaaucaugaucaaugauugaguaagaucuucucucaucaacauaugucuauagaacgacguuucaucaggagaauuauugaaaacuugcaagaacugagaccuccuuagaugguacaugaauugcggauagaggcuaaaguuuuggccuaaucugaaugaaccagcaucgucuuuauuguauucuccgaauuuuugacacaaucgaaucagcauucuaucgacccaucucagaacgucgggacucucaucugauucagcucuauaaacagccauucuggccauaauuacagcugcugcuuccugaucaaaaccagcgcugaugugguggauauuaguaguggcaucagc

SEQ ID NO: 1376 - RNA, 352 nt, artificial sequence
  synthetic construct
gugucuauagaacgacguuucaucaggagaauuauugaaaacuugcaagaacugagaccuccuuagaugguacaugaauugcggauagaggcuaaaguuuuggccuaaucugaaugaaccagcaucgucuuuauuguauucuccgaauuuuugacacaaucgaaucagcauucuaucgacccaucucagaacgucgggacucucaucugauucagcucuauaaacagccauucuggccauaauuacagcugcugcuuccugaucaaaaccagcgcugaugugguggauauuaguaguggcaucagcccaguuucgagccacuguugucacucuaauucuucuuugaccacuc

SEQ ID NO: 1377 - RNA, 351 nt, artificial sequence
  synthetic construct
gcuuuuuggagagcuucagcugcauucuucauugaaucuaagacggcuguguuggugcuggcuccuucgagggccucccuuugcauuucgauuguagugagugugccaucgauuuguaauugaguuuuuuccaaucguuuuuucuuuuugagcgccugcagcgcgacucucuuauucuuugaugcauuuuuuuuggcuacuaguguauauuccucuauuuucuuuucuaaaaacucuuguuuuuuauauaacauguccucgguuucccugagcuuuuggauggcuucgccuggcguggggcccacauccuuuucuuuuccuccgaauauuuuacuaaagaaacucauuguc

SEQ ID NO: 1378 - RNA, 351 nt, artificial sequence
  synthetic construct
gucaaauucgccagggcguccuccccgaagaucgauuucgcguacauauuggccgccaugaagccgcauugcccgccgagcgccuucucugaugucaggcacuucauguuaguacucuucagcagaugcuccagguacucguugagauccgucagcggcguauugacggucaccuuauucucccauucgaauucagcccacauccucauaaacuccgaaucggugcacgaugccggaacaauguaauccauaauaucgauguguaugucguucaaaacgacuacauuccuguccgaagcggcgccugucacgucguacacgauguuaccgaauaugauaccauucucgguc

SEQ ID NO: 1379 - RNA, 352 nt, artificial sequence
  synthetic construct
gaauaucgauguguaugucguucaaaacgacuacauuccuguccgaagcggcgccugucacgucguacacgauguuaccgaauaugauaccauucucggucgaggccacuuucacguuagccuugauauugcagaaauccuucggcgccagaacgaccggcugaggcuucuccaccaacuucaaaucgcccagagucgccaacuccagaguacaauucugcagcgugucgcucguuugguucaccaccaacacguccagcacgauaucguacugauuaacgugcacauacgcuucggaguaaacaggauccgagaaacccgucaacugggcgaucuuguucaauuuacucgc

SEQ ID NO: 1380 - RNA, 352 nt, artificial sequence
  synthetic construct
gauuucgcguacauauuggccgccaugaagccgcauugcccgccgagcgccuucucugaugucaggcacuucauguuaguacucuucagcagaugcuccagguacucguugagauccgucagcggcguauugacggucaccuuauucucccauucgaauucagcccacauccucauaaacuccgaaucggugcacgaugccggaacaauguaauccauaauaucgauguguaugucguucaaaacgacuacauuccuguccgaagcggcgccugucacgucguacacgauguuaccgaauaugauaccauucucggucgaggccacuuucacguuagccuugauauugcagc

SEQ ID NO: 1381 - RNA, 352 nt, artificial sequence
  synthetic construct
gauauuggccgccaugaagccgcauugcccgccgagcgccuucucugaugucaggcacuucauguuaguacucuucagcagaugcuccagguacucguugagauccgucagcggcguauugacggucaccuuauucucccauucgaauucagcccacauccucauaaacuccgaaucggugcacgaugccggaacaauguaauccauaauaucgauguguaugucguucaaaacgacuacauuccuguccgaagcggcgccugucacgucguacacgauguuaccgaauaugauaccauucucggucgaggccacuuucacguuagccuugauauugcagaaauccuucggc

SEQ ID NO: 1382 - RNA, 351 nt, artificial sequence
  synthetic construct
gucgauguguaugucguucaaaacgacuacauuccuguccgaagcggcgccugucacgucguacacgauguuaccgaauaugauaccauucucggucgaggccacuuucacguuagccuugauauugcagaaauccuucggcgccagaacgaccggcugaggcuucuccaccaacuucaaaucgcccagagucgccaacuccagaguacaauucugcagcgugucgcucguuugguucaccaccaacacguccagcacgauaucguacugauuaacgugcacauacgcuucggaguaaacaggauccgagaaacccgucaacugggcgaucuuguucaauuuacucgagcc

SEQ ID NO: 1383 - RNA, 352 nt, artificial sequence
  synthetic construct
guauucucccauucgaauucagcccacauccucauaaacuccgaaucggugcacgaugccggaacaauguaauccauaauaucgauguguaugucguucaaaacgacuacauuccuguccgaagcggcgccugucacgucguacacgauguuaccgaauaugauaccauucucggucgaggccacuuucacguuagccuugauauugcagaaauccuucggcgccagaacgaccggcugaggcuucuccaccaacuucaaaucgcccagagucgccaacuccagaguacaauucugcagcgugucgcucguuugguucaccaccaacacguccagcacgauaucguacugac

SEQ ID NO: 1384 - RNA, 351 nt, artificial sequence
  synthetic construct
guccgguaugugcaaggcugguuucgccggagacgacgccccgcgcgccgucuuccccucgaucgucggucgcccaagacaucagggugugauggucgguaugggacaaaaggacuccuacguaggagacgaggcccaaagcaaaagagguauccucacuuugaaauaccccaucgaacacgguaucaucaccaacugggaugacauggaaaagaucuggcaccacaccuucuacaacgaacuccgugucgcuccggaagaacaccccguccucuugaccgaggcuccucuuaacccuaaagccaacagggaaaagaugacccaaaucauguuugaaaccuucaacacacc

SEQ ID NO: 1385 - RNA, 351 nt, artificial sequence
  synthetic construct
gauccgguaugugcaaggcugguuucgccggagacgacgccccgcgcgccgucuuccccucgaucgucggucgcccaagacaucagggugugauggucgguaugggacaaaaggacuccuacguaggagacgaggcccaaagcaaaagagguauccucacuuugaaauaccccaucgaacacgguaucaucaccaacugggaugacauggaaaagaucuggcaccacaccuucuacaacgaacuccgugucgcuccggaagaacaccccguccucuugaccgaggcuccucuuaacccuaaagccaacagggaaaagaugacccaaaucauguuugaaaccuucaacacac

SEQ ID NO: 1386 - RNA, 351 nt, artificial sequence
  synthetic construct
gucuuggguauggaauccugcgguauccacgaaaccguauacaacuccaucaugaagugcgacgucgacauccguaaggacuuguacgccaacacuguacucuccggugguaccaccauguacccugguauugcugaccguaugcaaaaggaaaucaccgcucuugcccccagcacaaucaagaucaagaucauugcucccccagaaaggaaauacuccguauggaucgguggauccaucuuggcuucucuuuccacuuuccaacagauguggaucuccaaacaggaauacgacgaauccggcccuggaaucguucaccgcaagugcuucuaagcuauuuacuacucuuac

SEQ ID NO: 1387 - RNA, 352 nt, artificial sequence
  synthetic construct
guucuacaacgaacuccgugucgcuccggaagaacaccccguccucuugaccgaggcuccucuuaacccuaaagccaacagggaaaagaugacccaaaucauguuugaaaccuucaacacaccggccauguacgucgccauccaagccguacucucccucuacgcuuccggucguaccaccgguauuguauuggacuccggugacgguguaacccacaccguaccgaucuacgaagguuacgcucuuccccacgccauccuccguuuggacuuggccggucgcgauuugaccgacuaccucaugaaaauccucaccgaaagggguuacucguucaccaccaccgcugaaagc

SEQ ID NO: 1388 - RNA, 352 nt, artificial sequence
  synthetic construct
guuccaaccuuccuucuuggguauggaauccugcgguauccacgaaaccguauacaacuccaucaugaagugcgacgucgacauccguaaggacuuguacgccaacacuguacucuccggugguaccaccauguacccugguauugcugaccguaugcaaaaggaaaucaccgcucuugcccccagcacaaucaagaucaagaucauugcucccccagaaaggaaauacuccguauggaucgguggauccaucuuggcuucucuuuccacuuuccaacagauguggaucuccaaacaggaauacgacgaauccggcccuggaaucguucaccgcaagugcuucuaagcuauc

SEQ ID NO: 1389 - RNA, 352 nt, artificial sequence
  synthetic construct
guauccucacuuugaaauaccccaucgaacacgguaucaucaccaacugggaugacauggaaaagaucuggcaccacaccuucuacaacgaacuccgugucgcuccggaagaacaccccguccucuugaccgaggcuccucuuaacccuaaagccaacagggaaaagaugacccaaaucauguuugaaaccuucaacacaccggccauguacgucgccauccaagccguacucucccucuacgcuuccggucguaccaccgguauuguauuggacuccggugacgguguaacccacaccguaccgaucuacgaagguuacgcucuuccccacgccauccuccguuuggacuc

SEQ ID NO: 1390 - RNA, 352 nt, artificial sequence
  synthetic construct
gagaaacucugcuaugucgcccucgacuucgaacaggaaauggccaccgccgccgccuccaccucccucgaaaagagcuacgaacuucccgacggucaagucaucaccaucgguaacgaaagauuccguugcccugaggcucucuuccaaccuuccuucuuggguauggaauccugcgguauccacgaaaccguauacaacuccaucaugaagugcgacgucgacauccguaaggacuuguacgccaacacuguacucuccggugguaccaccauguacccugguauugcugaccguaugcaaaaggaaaucaccgcucuugcccccagcacaaucaagaucaagaucauuc

SEQ ID NO: 1391 - RNA, 352 nt, artificial sequence
  synthetic construct
gaaaagagcuacgaacuucccgacggucaagucaucaccaucgguaacgaaagauuccguugcccugaggcucucuuccaaccuuccuucuuggguauggaauccugcgguauccacgaaaccguauacaacuccaucaugaagugcgacgucgacauccguaaggacuuguacgccaacacuguacucuccggugguaccaccauguacccugguauugcugaccguaugcaaaaggaaaucaccgcucuugcccccagcacaaucaagaucaagaucauugcucccccagaaaggaaauacuccguauggaucgguggauccaucuuggcuucucuuuccacuuuccaac

SEQ ID NO: 1392 - RNA, 335 nt, artificial sequence
  synthetic construct
guuuacaauucuuuuucaaucuuaaugauuucuuggaugccaucguacaucuccuuaacggcaucgaacuccgugagacccaugcgucucuuguuggagaugucguagacaccgccuucggccucgguguguucaccgcgaguaccgcgcaccugcaaguuguacuuggcagcgaccuccuccagcuuggccuuguuggcagccaacuugggcaccuugauauggaccgaagcgcggacagugguacccaaguuagucgggcagaaggucaggaaaccgagccugucguugugggagaacggaagucucuuuucgaugucguugacggcgguuac

SEQ ID NO: 1393 - RNA, 283 nt, artificial sequence
  synthetic construct
gggcgggugcuugucggucuucuugaagccgccgugguaguccucgaugaugggaucgaagauguccgcgaauacgguguacgauucagcgucgggggcguagauuccuacgccggagucgugguucuccaagccggauuggaugacaucaagaagagucgagccgaaagugggggucuucuuggucuucaaguugucgaagaucuccugggugaggugcuucuucagcagcgauuuggagucggaguccuugauuuucuugaaaccggauucaaguuugucc

SEQ ID NO: 1394 - RNA, 135 nt, artificial sequence
  synthetic construct
gauuaaaggaaggaauggaugaaacgaugcccaguucacuccgcgaucguguccuuccaaaacgugcuucaccacagcaucggcuuggccaaauagcucgguggcucccggauuuuugagguggucuucgaggcc

SEQ ID NO: 1395 - RNA, 135 nt, artificial sequence; identical to SEQ ID NO: 1394
  synthetic construct

SEQ ID NO: 1396 - RNA, 153 nt, artificial sequence
  synthetic construct
guaagcugucuugaaauccuuuucaucggcugcgugcagcacgcccgauugcagaucgagggcggccugcaucuuuggagggcaauaaauagcguuagcggucguucuagcggaaguuagagcggcucgagcuuuggguaaauugcugagagc

SEQ ID NO: 1397 - RNA, 158 nt, artificial sequence
  synthetic construct
guaaaaauaggaguaagcugucuugaaauccuuuucaucggcugcgugcagcacgcccgauugcagaucgagggcggccugcaucuuuggagggcaauaaauagcguuagcggucguucuagcggaaguuagagcggcucgagcuuuggguaaauugc

SEQ ID NO: 1398 - RNA, 149 nt, artificial sequence
  synthetic construct
gcauguacuuaagagcagucagagcuuugggagauucgacgcuaucgaacccuucgaaggcuucguaaaaauaggaguaagcugucuugaaauccuuuucaucggcugcgugcagcacgcccgauugcagaucgagggcggccugcauc

SEQ ID NO: 1399 - RNA, 157 nt, artificial sequence
  synthetic construct
gaagacucaucacgaucagccuuaacuugcauaccaccaguaacacgagagaugguuucacgaccagagagaucgguaacgugaacgaaaguaucguugaaagaagcaaagaugugggcaacaccgaaaacgaguucaccuucacgaacuugaggac

SEQ ID NO: 1400 - RNA, 159 nt, artificial sequence
  synthetic construct
ggcagcaacuuguugggcagccaacauagcagcauaaggagaagacucaucacgaucagccuuaacuugcauaccaccaguaacacgagagaugguuucacgaccagagagaucgguaacgugaacgaaaguaucguugaaagaagcaaagaugugggc

SEQ ID NO: 1401 - RNA, 150 nt, artificial sequence
  synthetic construct
gccuuaacuugcauaccaccaguaacacgagagaugguuucacgaccagagagaucgguaacgugaacgaaaguaucguugaaagaagcaaagaugugggcaacaccgaaaacgaguucaccuucacgaacuugaggaccgagagugacc

SEQ ID NO: 1402 - RNA, 155 nt, artificial sequence
  synthetic construct
gcaacuuguugggcagccaacauagcagcauaaggagaagacucaucacgaucagccuuaacuugcauaccaccaguaacacgagagaugguuucacgaccagagagaucgguaacgugaacgaaaguaucguugaaagaagcaaagaugugggc

SEQ ID NO: 1403 - RNA, 144 nt, artificial sequence
  synthetic construct
ggaaggaauggaugaaacgaugcccaguucacuccgcgaucguguccuuccaaaacgugcuucaccacagcaucggcuuggccaaauagcucgguggcucccggauuuuugagguggucuucgaggcccgugggguguggugcc

SEQ ID NO: 1404 - RNA, 153 nt, artificial sequence
  synthetic construct
guggauggggaacaggaucaacuuggauuuguauucuuucaaacguugagcguuuaguugaauggauucuacggacuuguuccuccuccuguggucgacggcgacgccgacgguccuggcgaaucucggguuaagucccgcggcuuuuaauuc

SEQ ID NO: 1405 - RNA, 166 nt, artificial sequence
  synthetic construct
guauucuuucaaacguugagcguuuaguugaauggauucuacggacuuguuccuccuccuguggucgacggcgacgccgacgguccuggcgaaucucggguuaagucccgcggcuuuuaauucuugcagggugaauccgcguccggcgcguauuuuggugugguac

SEQ ID NO: 1406 - RNA, 154 nt, artificial sequence
  synthetic construct
gauuuguauucuuucaaacguugagcguuuaguugaauggauucuacggacuuguuccuccuccuguggucgacggcgacgccgacgguccuggcgaaucucggguuaagucccgcggcuuuuaauucuugcagggugaauccgcguccggcgc

SEQ ID NO: 1407 - RNA, 147 nt, artificial sequence
  synthetic construct
guaugauuagccaacauaagaccugagacucggugagcggacugaauguaaggagacuuccucgauagagccaccuguauacuagccgggccccaagggaugaacugggcgaguuugcguucgcguauccuuugcaacgauuuaugc

SEQ ID NO: 1408 - RNA, 153 nt, artificial sequence
  synthetic construct
gccaacauaagaccugagacucggugagcggacugaauguaaggagacuuccucgauagagccaccuguauacuagccgggccccaagggaugaacugggcgaguuugcguucgcguauccuuugcaacgauuuaugcacuugaguagcaucc

SEQ ID NO: 1409 - RNA, 157 nt, artificial sequence
  synthetic construct
gauuagccaacauaagaccugagacucggugagcggacugaauguaaggagacuuccucgauagagccaccuguauacuagccgggccccaagggaugaacugggcgaguuugcguucgcguauccuuugcaacgauuuaugcacuugaguagcauc

SEQ ID NO: 1410 - RNA, 158 nt, artificial sequence
  synthetic construct
guaugauuagccaacauaagaccugagacucggugagcggacugaauguaaggagacuuccucgauagagccaccuguauacuagccgggccccaagggaugaacugggcgaguuugcguucgcguauccuuugcaacgauuuaugcacuugaguagc

SEQ ID NO: 1411 - RNA, 256 nt, artificial sequence
  synthetic construct
guaaaaguuuuuagcuaagauuccaucuuucuucguuagccucacaaugcaaucaucugauucacccauucuccuaauagcuccacaaagagcauagcuuuucgaguucucggucauucuaccaguugcugggucaacaucagcuaugcuaaguuggaugcuagcaugguccuuagcauggauaauucuguuacuggcagaacauuuucuugggcaguacaaaucaacgguuucuccugcgucguuuuccauuauc

SEQ ID NO: 1412 - RNA, 352 nt, artificial sequence
  synthetic construct
gaggagugcaucuaauucuuguuugcuuucuacgaaucuugaccugucauuagcaucaauaagaaacacuauugcaucuacagcuggaaaauaguccuuccauacccuucuagcuugagagugacccccuaagucaaaaguaguaaaccucauacuaccaauagacaauucuucagaugucggauguaacguaggcaaaugcugggcuagucuaucgucuuuuaacauguguaaaagggugguuuuaccagcauuaucaaguccuaaaaagagcagcuuaccagauuucuuccauagaccuaaauauccgagcacuccugugaaccagucccauaugaacauuuugacuaac

SEQ ID NO: 1413 - RNA, 352 nt, artificial sequence
  synthetic construct
guauaaagcauaaaaauuucguaguucgucuucagaggcugcaccuggcaggucaauuuuauugccuaaaauuaggacaggacaguuugcuagaguuucaucuguuaggagugcaucuaauucuuguuugcuuucuacgaaucuugaccugucauuagcaucaauaagaaacacuauugcaucuacagcuggaaaauaguccuuccauacccuucuagcuugagagugacccccuaagucaaaaguaguaaaccucauacuaccaauagacaauucuucagaugucggauguaacguaggcaaaugcugggcuagucuaucgucuuuuaacauguguaaaagggugguuuuc

SEQ ID NO: 1414 - RNA, 350 nt, artificial sequence
  synthetic construct
gccuaaaauuaggacaggacaguuugcuagaguuucaucuguuaggagugcaucuaauucuuguuugcuuucuacgaaucuugaccugucauuagcaucaauaagaaacacuauugcaucuacagcuggaaaauaguccuuccauacccuucuagcuugagagugacccccuaagucaaaaguaguaaaccucauacuaccaauagacaauucuucagaugucggauguaacguaggcaaaugcugggcuagucuaucgucuuuuaacauguguaaaagggugguuuuaccagcauuaucaaguccuaaaaagagcagcuuaccagauuucuuccauagaccuaaauauc

SEQ ID NO: 1415 - RNA, 352 nt, artificial sequence
  synthetic construct
guuucguaguucgucuucagaggcugcaccuggcaggucaauuuuauugccuaaaauuaggacaggacaguuugcuagaguuucaucuguuaggagugcaucuaauucuuguuugcuuucuacgaaucuugaccugucauuagcaucaauaagaaacacuauugcaucuacagcuggaaaauaguccuuccauacccuucuagcuugagagugacccccuaagucaaaaguaguaaaccucauacuaccaauagacaauucuucagaugucggauguaacguaggcaaaugcugggcuagucuaucgucuuuuaacauguguaaaagggugguuuuaccagcauuaucaagc

SEQ ID NO: 1416 - RNA, 351 nt, artificial sequence
  synthetic construct
gaaauuaggacaggacaguuugcuagaguuucaucuguuaggagugcaucuaauucuuguuugcuuucuacgaaucuugaccugucauuagcaucaauaagaaacacuauugcaucuacagcuggaaaauaguccuuccauacccuucuagcuugagagugacccccuaagucaaaaguaguaaaccucauacuaccaauagacaauucuucagaugucggauguaacguaggcaaaugcugggcuagucuaucgucuuuuaacauguguaaaagggugguuuuaccagcauuaucaaguccuaaaaagagcagcuuaccagauuucuuccauagaccuaaauauccgagc

SEQ ID NO: 1417 - RNA, 351 nt, artificial sequence
  synthetic construct
guuucaucuguuaggagugcaucuaauucuuguuugcuuucuacgaaucuugaccugucauuagcaucaauaagaaacacuauugcaucuacagcuggaaaauaguccuuccauacccuucuagcuugagagugacccccuaagucaaaaguaguaaaccucauacuaccaauagacaauucuucagaugucggauguaacguaggcaaaugcugggcuagucuaucgucuuuuaacauguguaaaagggugguuuuaccagcauuaucaaguccuaaaaagagcagcuuaccagauuucuuccauagaccuaaauauccgagcacuccugugaaccagucccauaugaac

SEQ ID NO: 1418 - RNA, 351 nt, artificial sequence
  synthetic construct
guaauuucuuuaauaacagcuucaaugucugagacagaaguggcauauucucccaauauccaaagagcugcucuaugcacuuuaacagauuuuauaucuuugaauguuucuagaaguuucucaauaauaagugguugcagauuaucaaacuucuguauggccucucucaaaaauaguaacacgucaguagcagcuaacucguuacuaucagacaaaaauuccauuaaaacaggaaugacaguuacagcuacaucugggaauuuuauacaacaagaaugaaguguucuaacaaguaacugccuguauuuuccuguaucuucgugcucgcuaucuacgguuuuugauaccucc

SEQ ID NO: 1419 - RNA, 352 nt, artificial sequence
  synthetic construct
guuucuaugcucaaauuugcaagcgcgucuucuccgaaaauagauuuggcauacauauuggcggccauaaauccgcauugaccgcuaagggcuuuuucggaagucagacauuucauguuuguacuuuucaagagauggucaagguaaucggcgaggucugugagagguguauuuacagugaccuuauuuucccauucaaauucugcccacauccucauaaacucgguaucuguacagcucgcgggaacaauauaauccauaauaucgauaugaaugucguuuaaaaccacuacauuucuaucugaagcggcaccggugacgucguaaacaauauuaccaaauauaaugccgc

SEQ ID NO: 1420 - RNA, 351 nt, artificial sequence
  synthetic construct
gucgccgcucuuguccgcuucuaauugaaggaaacugauagcgucaucuguuuggauagugugucuggauuguucuuucgauuuuugagucguggcuucuuccguuuccuucgcuaucaacaugucauugagagcagaucgacacagaguagagaaaauuuguauuauugggucggugcggucugagaugacacgcaagcaaaaaaguauguggucuuugucaucguugguuauugguuuugucgguaaaccugauuugccuaaauguaugauaccugccauaauaagcaugacuucagcaucaaaccuauuucuaucagcagcugaggcaauuugaccauaucuuaaagc

SEQ ID NO: 1421 - RNA, 351 nt, artificial sequence
  synthetic construct
gaguguuacaaguguaccagcagcuucauaucugacagcaggacugcuugaauuuaauagauuguaaaugcagcggauaaaucuugaccucucugugggauuugaauggcaaacuuuauagauuaauucaacaaugaccaauugcagaaugucuccaaaugauguaacuugaucuagacaauuugccaaauaagacagugcucuaucuugaucagcauguaaaagcaucagaaaagcauuucucuugcaagacauauccugcucaccaucuaaauaaguagaaauaaguucgggugcaucaggaauuaagaacucaaaauuucuauaaauuguaaaaauagccaaaacugc

SEQ ID NO: 1422 - RNA, 351 nt, artificial sequence
  synthetic construct
guuuaauagauuguaaaugcagcggauaaaucuugaccucucugugggauuugaauggcaaacuuuauagauuaauucaacaaugaccaauugcagaaugucuccaaaugauguaacuugaucuagacaauuugccaaauaagacagugcucuaucuugaucagcauguaaaagcaucagaaaagcauuucucuugcaagacauauccugcucaccaucuaaauaaguagaaauaaguucgggugcaucaggaauuaagaacucaaaauuucuauaaauuguaaaaauagccaaaacugcauuucuucgcacauaacugugccugugauccaaacaggcucugauacuagc

SEQ ID NO: 1423 - RNA, 352 nt, artificial sequence
  synthetic construct
guuauacaacaagaaugaaguguucuaacaaguaacugccuguauuuuccuguaucuucgugcucgcuaucuacgguuuuugauaccuccuuuuuaagaaccaaaaccauuucuucuauauuacgagaugauaccaguucaagugcuagguuuaaagucuuuuugcgaacuuccaagucaggagcuugcaacacucuuaauauauccauaaccaaaucuugcaaaacccuuucauggcugggauguuccuuaagggcaaucaaucuguccaagacaaucaacuuuacauuauuaucacuuuccuugauaauuaguucaauauaacaacuagcagcugcuuuuacugcugugc

SEQ ID NO: 1424 - RNA, 350 nt, artificial sequence
  synthetic construct
gcacuugaaaguguuacaaguguaccagcagcuucauaucugacagcaggacugcuugaauuuaauagauuguaaaugcagcggauaaaucuugaccucucugugggauuugaauggcaaacuuuauagauuaauucaacaaugaccaauugcagaaugucuccaaaugauguaacuugaucuagacaauuugccaaauaagacagugcucuaucuugaucagcauguaaaagcaucagaaaagcauuucucuugcaagacauauccugcucaccaucuaaauaaguagaaauaaguucgggugcaucaggaauuaagaacucaaaauuucuauaaauuguaaaaauagc

SEQ ID NO: 1425 - RNA, 352 nt, artificial sequence
  synthetic construct
guaucaacaugucauugagagcagaucgacacagaguagagaaaauuuguauuauugggucggugcggucugagaugacacgcaagcaaaaaaguauguggucuuugucaucguugguuauugguuuugucgguaaaccugauuugccuaaauguaugauaccugccauaauaagcaugacuucagcaucaaaccuauuucuaucagcagcugaggcaauuugaccauaucuuaaagcuaauuugguuagaguagaagccaaggacgcuccuauaaaaaaaucaccauccauaagauauugccucagaggaggucguuuuucuuuugaagauuuacugacugaauuaaaggc

SEQ ID NO: 1426 - RNA, 352 nt, artificial sequence
  synthetic construct
guaucaccuaaacucaaagccauuccuugacuuuuagcucuaauccugaugugcccugcgacuggugcaucugguuuguugaaaggcuuuucuaugcucaaauuugcaagcgcgucuucuccgaaaauagauuuggcauacauauuggcggccauaaauccgcauugaccgcuaagggcuuuuucggaagucagacauuucauguuuguacuuuucaagagauggucaagguaaucggcgaggucugugagagguguauuuacagugaccuuauuuucccauucaaauucugcccacauccucauaaacucgguaucuguacagcucgcgggaacaauauaauccauaauac

SEQ ID NO: 1427 - RNA, 352 nt, artificial sequence
  synthetic construct
gaauaauuugccaucaggugaaguuuuugguacaauuucccaaaaaauuagaaguaauuucuuagcuaaaugauccugaaggggaaggacauuccuuauaauagucauuaagaauccguuugguaaucuuucuccagcuaauaucauguguauaauccuuucaagugcucuuauuuuuaccuuaaccucgcccuuuucgagguccauuuugagcugcauuucauuguagggcuccgaaucaguugguagauuaauuaaaguauaacaagacuguucaacggcagucauuuuaauuagaacgcgauucuggugaaauaagaauuguagauuuauuuuucgguaguauuuaaac

SEQ ID NO: 1428 - RNA, 350 nt, artificial sequence
  synthetic construct
ggauagugugucuggauuguucuuucgauuuuugagucguggcuucuuccguuuccuucgcuaucaacaugucauugagagcagaucgacacagaguagagaaaauuuguauuauugggucggugcggucugagaugacacgcaagcaaaaaaguauguggucuuugucaucguugguuauugguuuugucgguaaaccugauuugccuaaauguaugauaccugccauaauaagcaugacuucagcaucaaaccuauuucuaucagcagcugaggcaauuugaccauaucuuaaagcuaauuugguuagaguagaagccaaggacgcuccuauaaaaaaaucaccaucc

SEQ ID NO: 1429 - RNA, 350 nt, artificial sequence
  synthetic construct
gauugauacucuuuguccauucacuuuagcaaaaccucucuuguaaauuaauucccuaacagauuucaaauugggguaaccccauguaauguaagguucacauauucuaagcauguuaaugguagcuuuguugaguuuuacaaaaacuccauuguugaucugaaguagacggaaaaguugaagaacuuuacguacuuuuggugcuacuuuauugauacccuuaauacggauaacgaaagccaauuuagccucuccagguacauagaaauuacccuuauuuuuagcuugacgaauuaaccuuauuucaucucguucuuuuaaucuguauuccuuaacauacuguucugcuc

SEQ ID NO: 1430 - RNA, 351 nt, artificial sequence
  synthetic construct
gcaaugaucugauugcuagugauugauacucuuuguccauucacuuuagcaaaaccucucuuguaaauuaauucccuaacagauuucaaauugggguaaccccauguaauguaagguucacauauucuaagcauguuaaugguagcuuuguugaguuuuacaaaaacuccauuguugaucugaaguagacggaaaaguugaagaacuuuacguacuuuuggugcuacuuuauugauacccuuaauacggauaacgaaagccaauuuagccucuccagguacauagaaauuacccuuauuuuuagcuugacgaauuaaccuuauuucaucucguucuuuuaaucuguauucc

SEQ ID NO: 1431 - RNA, 352 nt, artificial sequence
  synthetic construct
guuuuaucuucucuauuaccaaagucaccaccuucuacauagugauuggucuucuuacgccagccaccaguugguguguuuagcuugaagggccauaagaaguuggaggcauauuugaaccuggauccaacagugaacaguucaugaaucaaaucuucaauacagauaaugccagauuuuccuaaucugucuucaaugaucugauugcuagugauugauacucuuuguccauucacuuuagcaaaaccucucuuguaaauuaauucccuaacagauuucaaauugggguaaccccauguaauguaagguucacauauucuaagcauguuaaugguagcuuuguugaguuuuc

SEQ ID NO: 1432 - RNA, 352 nt, artificial sequence
  synthetic construct
guucacauauucuaagcauguuaaugguagcuuuguugaguuuuacaaaaacuccauuguugaucugaaguagacggaaaaguugaagaacuuuacguacuuuuggugcuacuuuauugauacccuuaauacggauaacgaaagccaauuuagccucuccagguacauagaaauuacccuuauuuuuagcuugacgaauuaaccuuauuucaucucguucuuuuaaucuguauuccuuaacauacuguucugcucuuuugaaaauaucuuuucucuuuuugauuuguucagacuucuucuuuacaauggauugaagccuuuuagcccuagaggcuucacgucuuuugcgguc

SEQ ID NO: 1433 - RNA, 352 nt, artificial sequence
  synthetic construct
gauugauacucuuuguccauucacuuuagcaaaaccucucuuguaaauuaauucccuaacagauuucaaauugggguaaccccauguaauguaagguucacauauucuaagcauguuaaugguagcuuuguugaguuuuacaaaaacuccauuguugaucugaaguagacggaaaaguugaagaacuuuacguacuuuuggugcuacuuuauugauacccuuaauacggauaacgaaagccaauuuagccucuccagguacauagaaauuacccuuauuuuuagcuugacgaauuaaccuuauuucaucucguucuuuuaaucuguauuccuuaacauacuguucugcucuc

SEQ ID NO: 1434 - RNA, 352 nt, artificial sequence
  synthetic construct
guaaucugucuucaaugaucugauugcuagugauugauacucuuuguccauucacuuuagcaaaaccucucuuguaaauuaauucccuaacagauuucaaauugggguaaccccauguaauguaagguucacauauucuaagcauguuaaugguagcuuuguugaguuuuacaaaaacuccauuguugaucugaaguagacggaaaaguugaagaacuuuacguacuuuuggugcuacuuuauugauacccuuaauacggauaacgaaagccaauuuagccucuccagguacauagaaauuacccuuauuuuuagcuugacgaauuaaccuuauuucaucucguucuuuuac

SEQ ID NO: 1435 - RNA, 351 nt, artificial sequence
  synthetic construct
gacagauaaugccagauuuuccuaaucugucuucaaugaucugauugcuagugauugauacucuuuguccauucacuuuagcaaaaccucucuuguaaauuaauucccuaacagauuucaaauugggguaaccccauguaauguaagguucacauauucuaagcauguuaaugguagcuuuguugaguuuuacaaaaacuccauuguugaucugaaguagacggaaaaguugaagaacuuuacguacuuuuggugcuacuuuauugauacccuuaauacggauaacgaaagccaauuuagccucuccagguacauagaaauuacccuuauuuuuagcuugacgaauuaacc

SEQ ID NO: 1436 - RNA, 351 nt, artificial sequence
  synthetic construct
guuggaggcauauuugaaccuggauccaacagugaacaguucaugaaucaaaucuucaauacagauaaugccagauuuuccuaaucugucuucaaugaucugauugcuagugauugauacucuuuguccauucacuuuagcaaaaccucucuuguaaauuaauucccuaacagauuucaaauugggguaaccccauguaauguaagguucacauauucuaagcauguuaaugguagcuuuguugaguuuuacaaaaacuccauuguugaucugaaguagacggaaaaguugaagaacuuuacguacuuuuggugcuacuuuauugauacccuuaauacggauaacgaaagc

SEQ ID NO: 1437 - RNA, 351 nt, artificial sequence
  synthetic construct
guauuugaaccuggauccaacagugaacaguucaugaaucaaaucuucaauacagauaaugccagauuuuccuaaucugucuucaaugaucugauugcuagugauugauacucuuuguccauucacuuuagcaaaaccucucuuguaaauuaauucccuaacagauuucaaauugggguaaccccauguaauguaagguucacauauucuaagcauguuaaugguagcuuuguugaguuuuacaaaaacuccauuguugaucugaaguagacggaaaaguugaagaacuuuacguacuuuuggugcuacuuuauugauacccuuaauacggauaacgaaagccaauuuagc

SEQ ID NO: 1438 - RNA, 351 nt, artificial sequence
  synthetic construct
gaguagacggaaaaguugaagaacuuuacguacuuuuggugcuacuuuauugauacccuuaauacggauaacgaaagccaauuuagccucuccagguacauagaaauuacccuuauuuuuagcuugacgaauuaaccuuauuucaucucguucuuuuaaucuguauuccuuaacauacuguucugcucuuuugaaaauaucuuuucucuuuuugauuuguucagacuucuucuuuacaauggauugaagccuuuuagcccuagaggcuucacgucuuuugcgguguuuuaagaccgauucaggaacugcaggcagucccuuuacggucuuaguuuuuuugucaguuuuagc

SEQ ID NO: 1439 - RNA, 351 nt, artificial sequence
  synthetic construct
gaucugauugcuagugauugauacucuuuguccauucacuuuagcaaaaccucucuuguaaauuaauucccuaacagauuucaaauugggguaaccccauguaauguaagguucacauauucuaagcauguuaaugguagcuuuguugaguuuuacaaaaacuccauuguugaucugaaguagacggaaaaguugaagaacuuuacguacuuuuggugcuacuuuauugauacccuuaauacggauaacgaaagccaauuuagccucuccagguacauagaaauuacccuuauuuuuagcuugacgaauuaaccuuauuucaucucguucuuuuaaucuguauuccuuaac

SEQ ID NO: 1440 - RNA, 351 nt, artificial sequence
  synthetic construct
guuuucauacucuguauugcauucuucucuucccgaagguguaaaauucgaauauuccggaaaguauuucucuauuuuucuuccuuguucgaucuuccuuugaaguaugucuugcuuauucagaaaaacaaucauugcggcaucuuuaacauacacauuugaauagauaucuugaaacagauuaaaagacuccugaagucuauuaacgcuuucgucuucucuuaauuucaaaucaaaaucgcuggacgcuauuaaaaauagaauagccugaaugccggcgaacacuuuuauccauuuuuuucuuucgccacguugcccgccuacaucgaacauccagaauucagccaugcc

SEQ ID NO: 1441 - RNA, 352 nt, artificial sequence
  synthetic construct
guuaaaguauuccggaguaaauucauuugguccuucuuggccuauuuucacgaugaaaucgaucgaauuuauaguuuccucguuuuugacuuugacaggaggauuaauuuuauucauauuagugaugaugucauagauagauucaugaauauuuuguuugauguaugggauuuuuucuuuucuuucauuaucugaguaaccauuaauauguaaaauuuucaucuguuugaugaucguaguuuuuccagacucgccaguucccaaaaguaaaaguuuuuucacuucuaaaaacuuuuucguauagagaagauggucuuugucuucuuuaccaucuuuaccacauaccaucuuc

SEQ ID NO: 1442 - RNA, 351 nt, artificial sequence
  synthetic construct
guuuucauaaacaaucuaacuuuuucauacucuguauugcauucuucucuucccgaagguguaaaauucgaauauuccggaaaguauuucucuauuuuucuuccuuguucgaucuuccuuugaaguaugucuugcuuauucagaaaaacaaucauugcggcaucuuuaacauacacauuugaauagauaucuugaaacagauuaaaagacuccugaagucuauuaacgcuuucgucuucucuuaauuucaaaucaaaaucgcuggacgcuauuaaaaauagaauagccugaaugccggcgaacacuuuuauccauuuuuuucuuucgccacguugcccgccuacaucgaac

SEQ ID NO: 1443 - RNA, 352 nt, artificial sequence
  synthetic construct
guuucauaaacaaucuaacuuuuucauacucuguauugcauucuucucuucccgaagguguaaaauucgaauauuccggaaaguauuucucuauuuuucuuccuuguucgaucuuccuuugaaguaugucuugcuuauucagaaaaacaaucauugcggcaucuuuaacauacacauuugaauagauaucuugaaacagauuaaaagacuccugaagucuauuaacgcuuucgucuucucuuaauuucaaaucaaaaucgcuggacgcuauuaaaaauagaauagccugaaugccggcgaacacuuuuauccauuuuuuucuuucgccacguugcccgccuacaucgaacac

SEQ ID NO: 1444 - RNA, 351 nt, artificial sequence
  synthetic construct
guaccuggucucauucccauauuuucuacgaauacaggcauucuugcaauuccuaaaaucuuguuuuucauaaacaaucuaacuuuuucauacucuguauugcauucuucucuucccgaagguguaaaauucgaauauuccggaaaguauuucucuauuuuucuuccuuguucgaucuuccuuugaaguaugucuugcuuauucagaaaaacaaucauugcggcaucuuuaacauacacauuugaauagauaucuugaaacagauuaaaagacuccugaagucuauuaacgcuuucgucuucucuuaauuucaaaucaaaaucgcuggacgcuauuaaaaauagaauagcc

SEQ ID NO: 1445 - RNA, 351 nt, artificial sequence
  synthetic construct
gcucgguuuuagcuguucggugauauuuuuaccuggucucauucccauauuuucuacgaauacaggcauucuugcaauuccuaaaaucuuguuuuucauaaacaaucuaacuuuuucauacucuguauugcauucuucucuucccgaagguguaaaauucgaauauuccggaaaguauuucucuauuuuucuuccuuguucgaucuuccuuugaaguaugucuugcuuauucagaaaaacaaucauugcggcaucuuuaacauacacauuugaauagauaucuugaaacagauuaaaagacuccugaagucuauuaacgcuuucgucuucucuuaauuucaaaucaaaauc

SEQ ID NO: 1446 - RNA, 351 nt, artificial sequence
  synthetic construct
gauuguggauauauacaucccucgguuuuagcuguucggugauauuuuuaccuggucucauucccauauuuucuacgaauacaggcauucuugcaauuccuaaaaucuuguuuuucauaaacaaucuaacuuuuucauacucuguauugcauucuucucuucccgaagguguaaaauucgaauauuccggaaaguauuucucuauuuuucuuccuuguucgaucuuccuuugaaguaugucuugcuuauucagaaaaacaaucauugcggcaucuuuaacauacacauuugaauagauaucuugaaacagauuaaaagacuccugaagucuauuaacgcuuucgucuucuc

SEQ ID NO: 1447 - RNA, 352 nt, artificial sequence
  synthetic construct
guuuuagcuguucggugauauuuuuaccuggucucauucccauauuuucuacgaauacaggcauucuugcaauuccuaaaaucuuguuuuucauaaacaaucuaacuuuuucauacucuguauugcauucuucucuucccgaagguguaaaauucgaauauuccggaaaguauuucucuauuuuucuuccuuguucgaucuuccuuugaaguaugucuugcuuauucagaaaaacaaucauugcggcaucuuuaacauacacauuugaauagauaucuugaaacagauuaaaagacuccugaagucuauuaacgcuuucgucuucucuuaauuucaaaucaaaaucgcuggc

SEQ ID NO: 1448 - RNA, 351 nt, artificial sequence
  synthetic construct
guauauacaucccucgguuuuagcuguucggugauauuuuuaccuggucucauucccauauuuucuacgaauacaggcauucuugcaauuccuaaaaucuuguuuuucauaaacaaucuaacuuuuucauacucuguauugcauucuucucuucccgaagguguaaaauucgaauauuccggaaaguauuucucuauuuuucuuccuuguucgaucuuccuuugaaguaugucuugcuuauucagaaaaacaaucauugcggcaucuuuaacauacacauuugaauagauaucuugaaacagauuaaaagacuccugaagucuauuaacgcuuucgucuucucuuaauuuc

SEQ ID NO: 1449 - RNA, 352 nt, artificial sequence
  synthetic construct
guauugcauucuucucuucccgaagguguaaaauucgaauauuccggaaaguauuucucuauuuuucuuccuuguucgaucuuccuuugaaguaugucuugcuuauucagaaaaacaaucauugcggcaucuuuaacauacacauuugaauagauaucuugaaacagauuaaaagacuccugaagucuauuaacgcuuucgucuucucuuaauuucaaaucaaaaucgcuggacgcuauuaaaaauagaauagccugaaugccggcgaacacuuuuauccauuuuuuucuuucgccacguugcccgccuacaucgaacauccagaauucagccaugccgccuccguauuuuc

SEQ ID NO: 1450 - RNA, 352 nt, artificial sequence
  synthetic construct
gucuguucgggcguuuacaucaaaaagaucgccagcacccaaagcguauguuaaggaaucuucaaaugcucccaaaugguaguaaacuuuacuugcuaccaaugcagccaguuggugcuguugaaauacuuugucuucaugaagaauuucaauuuucucgauagcuucugaaaucucuggccaaaauucaucaacaauggaaucuaauuuuuuuagagcaaauacuuucaauucuggucuugguucuucuaguagggauauuauccccgcagcugaaguaauauucauuuuaaaagcacuugaaaaucuuaauaaguuuucguugcaagcacaauuaaaauuuucggaaauc

SEQ ID NO: 1451 - RNA, 351 nt, artificial sequence
  synthetic construct
gccgcuacguguaguaauuuccugauggcuugauuguguccaguaccgcaguaagccauggcuaagguauacauuccggaccgucuuaaaauuggauccuuaucugaagucagcugauggauuagugaaucggccucuucuagacgaccguacaucgugaaacuuauacccacugcuaauccacgcaggauuuuuucauguugacuuucuugugcguacgccaccauauccauuauaguugccgaauuauuggagcccaacaugaccauacccauggcuauaccagcggcuucuccgguauucgcgucgucuugauagagauugaauuugaguuguucauaaacgucgugc

SEQ ID NO: 1452 - RNA, 352 nt, artificial sequence
  synthetic construct
guaccaauaaugucaucagcuuguguaauggacaauucaaaaauguccauucuucuaguuuccaaagcgagucccauggccugucgguuuuguccgucaucuaaacaacguugaaacauacgauucacaauggccucaagucuggcaucaaugggcuuugcaucucguacgccuucagccaaagcaaugcgauguuguguguaauaaucaauacauuuggcaagugucguuuccacauacucuguucgggcguuuacaucaaaaagaucgccagcacccaaagcguauguuaaggaaucuucaaaugcucccaaaugguaguaaacuuuacuugcuaccaaugcagccaguc

SEQ ID NO: 1453 - RNA, 352 nt, artificial sequence
  synthetic construct
guuuggaucaaacucauagcgaccugaaaagcauaggucagcauaccaauaaugucaucagcuuguguaauggacaauucaaaaauguccauucuucuaguuuccaaagcgagucccauggccugucgguuuuguccgucaucuaaacaacguugaaacauacgauucacaauggccucaagucuggcaucaaugggcuuugcaucucguacgccuucagccaaagcaaugcgauguuguguguaauaaucaauacauuuggcaagugucguuuccacauacucuguucgggcguuuacaucaaaaagaucgccagcacccaaagcguauguuaaggaaucuucaaaugcuc

SEQ ID NO: 1454 - RNA, 352 nt, artificial sequence
  synthetic construct
guucugaauaacaagaaaccaagagcuguaacugcagcucuucggacaucaucguugacaucugacaccgcuacguguaguaauuuccugauggcuugauuguguccaguaccgcaguaagccauggcuaagguauacauuccggaccgucuuaaaauuggauccuuaucugaagucagcugauggauuagugaaucggccucuucuagacgaccguacaucgugaaacuuauacccacugcuaauccacgcaggauuuuuucauguugacuuucuugugcguacgccaccauauccauuauaguugccgaauuauuggagcccaacaugaccauacccauggcuauaccac

SEQ ID NO: 1455 - RNA, 351 nt, artificial sequence
  synthetic construct
gauuucgcaccaugaugaugccgccuaucgaaacaucuuucaucgccguguacugcgugcuaucguugauugugaucaccuucaauugcugccucaugguccuggcaggauuuugcaagauuucgaaauucgguucggguuccuucuucuucuccuccuuuucgucuuucuuuuccuuuuuaucaucggccgucgaaguugaagguuucuugucguccgcuuucuucucuucgggcuucuugucuuccuuuuuuucuuccgguuucuuuucuuccuuuucgguuuuuuugucguccuuuucuucguccacguccauuuuuucgucgcgaugcuuucuuucguggucucucc

SEQ ID NO: 1456 - RNA, 351 nt, artificial sequence
  synthetic construct
guuuaucuaagauuucagccacugggagagggucgucuaagaaaauuagacacuggcacauauugacguaaucgggaguaguuagaccccgauacagaccaacuagagaccucaggacgguguuucggaaugcgcgguuuuggaucaaacucauagcgaccugaaaagcauaggucagcauaccaauaaugucaucagcuuguguaauggacaauucaaaaauguccauucuucuaguuuccaaagcgagucccauggccugucgguuuuguccgucaucuaaacaacguugaaacauacgauucacaauggccucaagucuggcaucaaugggcuuugcaucucguacgc

SEQ ID NO: 1457 - RNA, 352 nt, artificial sequence
  synthetic construct
guaucgaaacaucuuucaucgccguguacugcgugcuaucguugauugugaucaccuucaauugcugccucaugguccuggcaggauuuugcaagauuucgaaauucgguucggguuccuucuucuucuccuccuuuucgucuuucuuuuccuuuuuaucaucggccgucgaaguugaagguuucuugucguccgcuuucuucucuucgggcuucuugucuuccuuuuuuucuuccgguuucuuuucuuccuuuucgguuuuuuugucguccuuuucuucguccacguccauuuuuucgucgcgaugcuuucuuucguggucucuccugcgcugccuagcggcuauacucac

SEQ ID NO: 1458 - RNA, 351 nt, artificial sequence
  synthetic construct
gucuaccaauucuucuucgccaggcuucaaauuucgcaccaugaugaugccgccuaucgaaacaucuuucaucgccguguacugcgugcuaucguugauugugaucaccuucaauugcugccucaugguccuggcaggauuuugcaagauuucgaaauucgguucggguuccuucuucuucuccuccuuuucgucuuucuuuuccuuuuuaucaucggccgucgaaguugaagguuucuugucguccgcuuucuucucuucgggcuucuugucuuccuuuuuuucuuccgguuucuuuucuuccuuuucgguuuuuuugucguccuuuucuucguccacguccauuuuuuc

SEQ ID NO: 1459 - RNA, 352 nt, artificial sequence
  synthetic construct
guucuaauucaucuucauccauaucaucugagaaaccaacuggauuacuaauagcguuugugaucucauuggcaaugucguguuguuccgcuauaucauccauuauaucaugaacauuaucaacauccagguucuugugugcuuuuuuaagggcaucagcagcauuuuucauagaaucuaaaaccgcuguguuaguacuagcuccuucgagggcuucccuuugcauuucaauaguuguaaguguuccaucgauuugcaguugagucuuuuccaaucuuuucuucuucuuaagagcuugaagggccacucguuuauucuuagaggcauuuuucuuagcuaauaauguguauuc

SEQ ID NO: 1460 - RNA, 352 nt, artificial sequence
  synthetic construct
guuucuaauucaucuucauccauaucaucugagaaaccaacuggauuacuaauagcguuugugaucucauuggcaaugucguguuguuccgcuauaucauccauuauaucaugaacauuaucaacauccagguucuugugugcuuuuuuaagggcaucagcagcauuuuucauagaaucuaaaaccgcuguguuaguacuagcuccuucgagggcuucccuuugcauuucaauaguuguaaguguuccaucgauuugcaguugagucuuuuccaaucuuuucuucuucuuaagagcuugaagggccacucguuuauucuuagaggcauuuuucuuagcuaauaauguguauc

SEQ ID NO: 1461 - RNA, 352 nt, artificial sequence
  synthetic construct
guuuuuaagggcaucagcagcauuuuucauagaaucuaaaaccgcuguguuaguacuagcuccuucgagggcuucccuuugcauuucaauaguuguaaguguuccaucgauuugcaguugagucuuuuccaaucuuuucuucuucuuaagagcuugaagggccacucguuuauucuuagaggcauuuuucuuagcuaauaauguguauucuucuauuuucuuuucuaaaaauuccuguuuuuuguauaacauuucuucaguuucucuaagcuucuggauagcuucgccugggguaggaccuucaucuuuuucuuucccuccgaauauuuuauugaaaaagcucauuuuaaac

SEQ ID NO: 1462 - RNA, 350 nt, artificial sequence
  synthetic construct
ggaaccuugaguaaaucuucuucuaaaccuucuuguucgagcuccuccaguuccuuuucuaauucaucuucauccauaucaucugagaaaccaacuggauuacuaauagcguuugugaucucauuggcaaugucguguuguuccgcuauaucauccauuauaucaugaacauuaucaacauccagguucuugugugcuuuuuuaagggcaucagcagcauuuuucauagaaucuaaaaccgcuguguuaguacuagcuccuucgagggcuucccuuugcauuucaauaguuguaaguguuccaucgauuugcaguugagucuuuuccaaucuuuucuucuucuuaagagc

SEQ ID NO: 1463 - RNA, 351 nt, artificial sequence
  synthetic construct
gucucauuggcaaugucguguuguuccgcuauaucauccauuauaucaugaacauuaucaacauccagguucuugugugcuuuuuuaagggcaucagcagcauuuuucauagaaucuaaaaccgcuguguuaguacuagcuccuucgagggcuucccuuugcauuucaauaguuguaaguguuccaucgauuugcaguugagucuuuuccaaucuuuucuucuucuuaagagcuugaagggccacucguuuauucuuagaggcauuuuucuuagcuaauaauguguauucuucuauuuucuuuucuaaaaauuccuguuuuuuguauaacauuucuucaguuucucuaagc

SEQ ID NO: 1464 - RNA, 352 nt, artificial sequence
  synthetic construct
guaaaccuucuuguucgagcuccuccaguuccuuuucuaauucaucuucauccauaucaucugagaaaccaacuggauuacuaauagcguuugugaucucauuggcaaugucguguuguuccgcuauaucauccauuauaucaugaacauuaucaacauccagguucuugugugcuuuuuuaagggcaucagcagcauuuuucauagaaucuaaaaccgcuguguuaguacuagcuccuucgagggcuucccuuugcauuucaauaguuguaaguguuccaucgauuugcaguugagucuuuuccaaucuuuucuucuucuuaagagcuugaagggccacucguuuauucuc

SEQ ID NO: 1465 - RNA, 351 nt, artificial sequence
  synthetic construct
gcugagaaaccaacuggauuacuaauagcguuugugaucucauuggcaaugucguguuguuccgcuauaucauccauuauaucaugaacauuaucaacauccagguucuugugugcuuuuuuaagggcaucagcagcauuuuucauagaaucuaaaaccgcuguguuaguacuagcuccuucgagggcuucccuuugcauuucaauaguuguaaguguuccaucgauuugcaguugagucuuuuccaaucuuuucuucuucuuaagagcuugaagggccacucguuuauucuuagaggcauuuuucuuagcuaauaauguguauucuucuauuuucuuuucuaaaaauucc

SEQ ID NO: 1466 - RNA, 352 nt, artificial sequence
  synthetic construct
guaucaucgucauccucgacuuuucuagcugcagguuuaacaacugccggcuuagcaauagcuccagcgggcacggcuggaaguucuguagguccgggaaccuugaguaaaucuucuucuaaaccuucuuguucgagcuccuccaguuccuuuucuaauucaucuucauccauaucaucugagaaaccaacuggauuacuaauagcguuugugaucucauuggcaaugucguguuguuccgcuauaucauccauuauaucaugaacauuaucaacauccagguucuugugugcuuuuuuaagggcaucagcagcauuuuucauagaaucuaaaaccgcuguguuaguacuac

SEQ ID NO: 1467 - RNA, 352 nt, artificial sequence
  synthetic construct
gucauaucaucgucauccucgacuuuucuagcugcagguuuaacaacugccggcuuagcaauagcuccagcgggcacggcuggaaguucuguagguccgggaaccuugaguaaaucuucuucuaaaccuucuuguucgagcuccuccaguuccuuuucuaauucaucuucauccauaucaucugagaaaccaacuggauuacuaauagcguuugugaucucauuggcaaugucguguuguuccgcuauaucauccauuauaucaugaacauuaucaacauccagguucuugugugcuuuuuuaagggcaucagcagcauuuuucauagaaucuaaaaccgcuguguuaguac

SEQ ID NO: 1468 - RNA, 352 nt, artificial sequence
  synthetic construct
guucuucuaaaccuucuuguucgagcuccuccaguuccuuuucuaauucaucuucauccauaucaucugagaaaccaacuggauuacuaauagcguuugugaucucauuggcaaugucguguuguuccgcuauaucauccauuauaucaugaacauuaucaacauccagguucuugugugcuuuuuuaagggcaucagcagcauuuuucauagaaucuaaaaccgcuguguuaguacuagcuccuucgagggcuucccuuugcauuucaauaguuguaaguguuccaucgauuugcaguugagucuuuuccaaucuuuucuucuucuuaagagcuugaagggccacucguuc

SEQ ID NO: 1469 - RNA, 352 nt, artificial sequence
  synthetic construct
guaauuccuucauaucaucgucauccucgacuuuucuagcugcagguuuaacaacugccggcuuagcaauagcuccagcgggcacggcuggaaguucuguagguccgggaaccuugaguaaaucuucuucuaaaccuucuuguucgagcuccuccaguuccuuuucuaauucaucuucauccauaucaucugagaaaccaacuggauuacuaauagcguuugugaucucauuggcaaugucguguuguuccgcuauaucauccauuauaucaugaacauuaucaacauccagguucuugugugcuuuuuuaagggcaucagcagcauuuuucauagaaucuaaaaccgcugc

SEQ ID NO: 1470 - RNA, 350 nt, artificial sequence
  synthetic construct
guuuuaagcgauucccaauaggaacgauucaaauaucuagccaauucuggaucuucuugaggcugaggaggaguuuguggucuuucgacugguguugguucuuucacauuauacaaagcacuuguugcccuuauuuuuucuuuuucuuuggcuucagcuucugauugacucaaagcuaaagcuaauugcaguuccuccucuucucucaauucaucuucacuuuucuuaggaggauccuguuucuguugugccaaugaacuuuuuaaauauuccucaggcaaaucuguuucacuggaagaaauagaagauuuugaugcaguggcugguuuaguaacuucaucauaacaagc

SEQ ID NO: 1471 - RNA, 351 nt, artificial sequence
  synthetic construct
guucccaauaggaacgauucaaauaucuagccaauucuggaucuucuugaggcugaggaggaguuuguggucuuucgacugguguugguucuuucacauuauacaaagcacuuguugcccuuauuuuuucuuuuucuuuggcuucagcuucugauugacucaaagcuaaagcuaauugcaguuccuccucuucucucaauucaucuucacuuuucuuaggaggauccuguuucuguugugccaaugaacuuuuuaaauauuccucaggcaaaucuguuucacuggaagaaauagaagauuuugaugcaguggcugguuuaguaacuucaucauaacaagcaucacauacuc

SEQ ID NO: 1472 - RNA, 351 nt, artificial sequence
  synthetic construct
gagacgauacgccguguccuacaaacugcggggcgccauuaggcagugaagaauucgaaguuacuccuugaggaaagccgggcggagggccuaaagcaguauuaugagcugguugcugcccuagaggaccauguggugguccuccagguaaaccgacuugacucggaacgcuuugcggaggcaucaugugcugaggaaaugaauaaguguuguaauuacccauggacugguucggguuggaaggaaacuguuguccaugauguggagaauucauauauccauauugagguaacauauauugcuguuuuugcuguuccugucucauuugcauuucucucucuuguucuuggc

SEQ ID NO: 1473 - RNA, 352 nt, artificial sequence
  synthetic construct
guauacaaagcacuuguugcccuuauuuuuucuuuuucuuuggcuucagcuucugauugacucaaagcuaaagcuaauugcaguuccuccucuucucucaauucaucuucacuuuucuuaggaggauccuguuucuguugugccaaugaacuuuuuaaauauuccucaggcaaaucuguuucacuggaagaaauagaagauuuugaugcaguggcugguuuaguaacuucaucauaacaagcaucacauacucucaccuccuuuucaauuccauauuugggcaaaguagaagucuuugaagugcacuggccacaaaacacuugaccacaggcucugcaaugaugcuuucuuc

SEQ ID NO: 1474 - RNA, 350 nt, artificial sequence
  synthetic construct
guugguuuuaagcgauucccaauaggaacgauucaaauaucuagccaauucuggaucuucuugaggcugaggaggaguuuguggucuuucgacugguguugguucuuucacauuauacaaagcacuuguugcccuuauuuuuucuuuuucuuuggcuucagcuucugauugacucaaagcuaaagcuaauugcaguuccuccucuucucucaauucaucuucacuuuucuuaggaggauccuguuucuguugugccaaugaacuuuuuaaauauuccucaggcaaaucuguuucacuggaagaaauagaagauuuugaugcaguggcugguuuaguaacuucaucauaac

SEQ ID NO: 1475 - RNA, 352 nt, artificial sequence
  synthetic construct
guuaacucugcaguuugugccucuccauuuguuuugacuuguggacuagccgguggagcuccaggcugcugaaauuggggcgacaucuguccuugaugcggaaaauuuugauucugagaaauuccuccuugcaugggaaucccacccugcugcggcggcaguccaccuugagggggcaucauuccacccugauuauggggaaucccgcccugauguugagguauucccuguuggguauucggagaauugggaggcaagccagguuguccgccgcccaucauauguugagacgauacgccguguccuacaaacugcggggcgccauuaggcagugaagaauucgaaguuacuc

SEQ ID NO: 1476 - RNA, 351 nt, artificial sequence
  synthetic construct
gaggaacgauucaaauaucuagccaauucuggaucuucuugaggcugaggaggaguuuguggucuuucgacugguguugguucuuucacauuauacaaagcacuuguugcccuuauuuuuucuuuuucuuuggcuucagcuucugauugacucaaagcuaaagcuaauugcaguuccuccucuucucucaauucaucuucacuuuucuuaggaggauccuguuucuguugugccaaugaacuuuuuaaauauuccucaggcaaaucuguuucacuggaagaaauagaagauuuugaugcaguggcugguuuaguaacuucaucauaacaagcaucacauacucucaccucc

SEQ ID NO: 1477 - RNA, 351 nt, artificial sequence
  synthetic construct
guugcaucugauucucuggguguuggaaauuugugaccuuccauuuucauuguauucacaagguccuuaagcgcuccauguuuaggauucuuccuaaagacaaaauuccagguuugaauaaguucuaacaguuuacuucgaacauuuucaugaggugugguuuuugauaauucaugaaggaaaucacagaaugauuuagugguuaauucuucaugaacuauuaugccacaauuuuuuaccauacuuuccaaaacuaacaaagcauacaaugcagaaugaggauuuugugaguauaguuucuuucuuaaugcaguuaaggcauaucuugguuguacaucauucugucuaauc

SEQ ID NO: 1478 - RNA, 351 nt, artificial sequence
  synthetic construct
gcuuuggcuucagcuucugauugacucaaagcuaaagcuaauugcaguuccuccucuucucucaauucaucuucacuuuucuuaggaggauccuguuucuguugugccaaugaacuuuuuaaauauuccucaggcaaaucuguuucacuggaagaaauagaagauuuugaugcaguggcugguuuaguaacuucaucauaacaagcaucacauacucucaccuccuuuucaauuccauauuugggcaaaguagaagucuuugaagugcacuggccacaaaacacuugaccacaggcucugcaaugaugcuuucuuuggaguacacugaauuguacacgacaucuaugacac

SEQ ID NO: 1479 - RNA, 352 nt, artificial sequence
  synthetic construct
guucacauuauacaaagcacuuguugcccuuauuuuuucuuuuucuuuggcuucagcuucugauugacucaaagcuaaagcuaauugcaguuccuccucuucucucaauucaucuucacuuuucuuaggaggauccuguuucuguugugccaaugaacuuuuuaaauauuccucaggcaaaucuguuucacuggaagaaauagaagauuuugaugcaguggcugguuuaguaacuucaucauaacaagcaucacauacucucaccuccuuuucaauuccauauuugggcaaaguagaagucuuugaagugcacuggccacaaaacacuugaccacaggcucugcaaugaugc

SEQ ID NO: 1480 - RNA, 350 nt, artificial sequence
  synthetic construct
guaaaccgacuugacucggaacgcuuugcggaggcaucaugugcugaggaaaugaauaaguguuguaauuacccauggacugguucggguuggaaggaaacuguuguccaugauguggagaauucauauauccauauugagguaacauauauugcuguuuuugcuguuccugucucauuugcauuucucucucuuguucuuggauccuuuguagcgccaauugucucugguacugaagauauuccuguuuuuucuuccucaugacuuccaauuuaugcgccauuugcauuugacgcauucuuucuugcuccucagccucucuucucaucuuuucauuguguucuucgcgc

SEQ ID NO: 1481 - RNA, 351 nt, artificial sequence
  synthetic construct
gaacauugcuggaguaaauccaggguuauuuuguuccaaaaauuucugugcuacuauugcuucuugaagaccaggaaacagauuuucauaaucuuuaggaucugccaagcuuuguccugcuuucugauugauaguagacaacuguguucuccagagaucuaccacuucugagauuuuaucagguaaguaagaccucgcaaagaaagcugcuucuggaagucuuccaguuguuaucaauauauucagacauuuauuuaaaucgccaacuaagaaaugagacaagaaagauagauuauguuugccuucuguuugaguggcauccccuagcgcccuuacuacuuuuucaucucc

SEQ ID NO: 1482 - RNA, 352 nt, artificial sequence
  synthetic construct
guuugucuacuaaauaaagccugucaucuuuagggacauaaccaagaacauaaagugguccaucuagaugggcuauuguuacaaguucaccuccaacaaaguaauuuauacgguuuacagaauuuguguaaaugaaacaaucuccuacccauagaccaguacguacagacucauuaauuucacccaagagauuaaaagccgauucaacuccaucaucagcaaccugauuauugucuuuggcccuuuguacuucaucagaaucauaugagaguauaaaauaacuaucuucaguggccaagcaaacuaauuugccacugucagaccaauauauugcccgugguuguauuucaac

SEQ ID NO: 1483 - RNA, 351 nt, artificial sequence
  synthetic construct
guuucaucuauauucacaccauccaggucuaaaucuaugucgucgucaucaucaucuugaucaauugagaguuucuucaauugcucaauaggugccuucacagaauauugagaagaacucccaguuacuccacuauucuucgacugggcuuccaccucagcuauaacguuucuuucaugauuuggggugauacugguugcuaacauugcuggaguaaauccaggguuauuuuguuccaaaaauuucugugcuacuauugcuucuugaagaccaggaaacagauuuucauaaucuuuaggaucugccaagcuuuguccugcuuucugauugauaguagacaacuguguucuc

SEQ ID NO: 1484 - RNA, 351 nt, artificial sequence
  synthetic construct
gucugaaugucuagcccaaauaauuuuuccaccacuugcauccauacuaacagcugguuccucucuaccaacuuucaccaaaaugcuacccucaucauaaccuaaagcaacauuauuggaacccuucaagcagaaaauaguccauacucuuucaaagccauaguucaaacugcuuucuaaucugugaguauuugcaugccaaacucugauaguaccaucuucacuuccaguaagagcuauugggaguucaggauggaaacaaacagcaguaacguuuuguccauguccuucuaaaguuuggacacaaguuuuauucugguaaucccaaauuuugacuaaucuaucaucugc

SEQ ID NO: 1485 - RNA, 351 nt, artificial sequence
  synthetic construct
gaauucugaaugucuagcccaaauaauuuuuccaccacuugcauccauacuaacagcugguuccucucuaccaacuuucaccaaaaugcuacccucaucauaaccuaaagcaacauuauuggaacccuucaagcagaaaauaguccauacucuuucaaagccauaguucaaacugcuuucuaaucugugaguauuugcaugccaaacucugauaguaccaucuucacuuccaguaagagcuauugggaguucaggauggaaacaaacagcaguaacguuuuguccauguccuucuaaaguuuggacacaaguuuuauucugguaaucccaaauuuugacuaaucuaucauc

SEQ ID NO: 1486 - RNA, 352 nt, artificial sequence
  synthetic construct
guugcauccauacuaacagcugguuccucucuaccaacuuucaccaaaaugcuacccucaucauaaccuaaagcaacauuauuggaacccuucaagcagaaaauaguccauacucuuucaaagccauaguucaaacugcuuucuaaucugugaguauuugcaugccaaacucugauaguaccaucuucacuuccaguaagagcuauugggaguucaggauggaaacaaacagcaguaacguuuuguccauguccuucuaaaguuuggacacaaguuuuauucugguaaucccaaauuuugacuaaucuaucaucugcaccagauauuagguaugguuuaucaccuccauggc

SEQ ID NO: 1487 - RNA, 352 nt, artificial sequence
  synthetic construct
gauucugaaugucuagcccaaauaauuuuuccaccacuugcauccauacuaacagcugguuccucucuaccaacuuucaccaaaaugcuacccucaucauaaccuaaagcaacauuauuggaacccuucaagcagaaaauaguccauacucuuucaaagccauaguucaaacugcuuucuaaucugugaguauuugcaugccaaacucugauaguaccaucuucacuuccaguaagagcuauugggaguucaggauggaaacaaacagcaguaacguuuuguccauguccuucuaaaguuuggacacaaguuuuauucugguaaucccaaauuuugacuaaucuaucaucuc

SEQ ID NO: 1488 - RNA, 352 nt, artificial sequence
  synthetic construct
gaccaaauccaaaguuucccaaucauagaaagucaauccagaaacagauuuuacacccagaagguagccuccaaauauaccuucagcaccaaaaucagauuugaaauucuucuuuucuuugaaauuuuuaaauauucuaauuguagauccagauucccugauagcauauucacuugaaucuugagcccacacaaacucuugggcacuuccaaaagcuuuguuccuuaaugccauagcuguguaaaugauguauucuccaucuccacaaacuaccacgaaacgaccauuuggauugugcuggauaguuuguggguagaugucacaugcacccauaucuuucacagaaacuggc

SEQ ID NO: 1489 - RNA, 352 nt, artificial sequence
  synthetic construct
guauuucaauucuucuaaccaaauccaaaguuucccaaucauagaaagucaauccagaaacagauuuuacacccagaagguagccuccaaauauaccuucagcaccaaaaucagauuugaaauucuucuuuucuuugaaauuuuuaaauauucuaauuguagauccagauucccugauagcauauucacuugaaucuugagcccacacaaacucuugggcacuuccaaaagcuuuguuccuuaaugccauagcuguguaaaugauguauucuccaucuccacaaacuaccacgaaacgaccauuuggauugugcuggauaguuuguggguagaugucacaugcacccauauc

SEQ ID NO: 1490 - RNA, 351 nt, artificial sequence
  synthetic construct
gcuuacuacuuuuucaucuccugagcuaguagcuaaaaguagcaacccuccguaaucuugagccuucugcauacauucuuuggcuaauucuagauuguucguagaagcugcaaguucggcaaguuggcuccauuucugaggguuauuagcuuccugagcuaaggcucuggcuguguuuagaucuucuagugcaacugcuaguucaaaucuauguucaggaucugaacuaacugccaaagcuuguugcuuaaaaccuugcuuuucuaagaaaugugccacucugguucuaugcucuuuuggaauagaaggcaagacucuaucagcaguugaaaaaucucuccucaucacagc

SEQ ID NO: 1491 - RNA, 351 nt, artificial sequence
  synthetic construct
guuccucucuaccaacuuucaccaaaaugcuacccucaucauaaccuaaagcaacauuauuggaacccuucaagcagaaaauaguccauacucuuucaaagccauaguucaaacugcuuucuaaucugugaguauuugcaugccaaacucugauaguaccaucuucacuuccaguaagagcuauugggaguucaggauggaaacaaacagcaguaacguuuuguccauguccuucuaaaguuuggacacaaguuuuauucugguaaucccaaauuuugacuaaucuaucaucugcaccagauauuagguaugguuuaucaccuccaugguaauaaucaacacaguuuacuc

SEQ ID NO: 1492 - RNA, 352 nt, artificial sequence
  synthetic construct
guuacggauaucaacgucacacuucaugauggaguuguagacgguuucguggauaccgcaagauuccauacccaagaaggaagguuggaagagggcuucuggacaacggaaucucucguuaccgauggugaugaccuguccaucgggaaguucguagcucuuuuccaaagagguugaagcggcagcgguggccauuuccuguucgaagucgagggcgacauagcaaaguuucuccuugaugucacggacgauuucucuuucagcugugguggugaaugaguaaccucuuucggucaagauuuucaugagguagucggucaaaucacgaccagccaaguccaaacggaggauc

SEQ ID NO: 1493 - RNA, 352 nt, artificial sequence
  synthetic construct
guugggguugaguggagcuucugucaggaggacgggguguucuucuggggcgacacggaguucguuguagaaggugugaugccagaucuuuuccauaucaucccaguuggugaugauaccguguucaaugggguauuucaaugugaggauaccucuuuugcuuugggcuucaucuccuacguaagagucuuuuugucccauuccuaccauuacacccugaugucuugggcguccgacgauggaugggaauacggcacggggcgcgucauccccggcgaaaccggccuugcacauaccggauccauugucuacaacuaaagcggcaacuucuucuucacacauuuugauaggc

SEQ ID NO: 1494 - RNA, 352 nt, artificial sequence
  synthetic construct
gugauuugggucaucuuuucucuguuugccuugggguugaguggagcuucugucaggaggacgggguguucuucuggggcgacacggaguucguuguagaaggugugaugccagaucuuuuccauaucaucccaguuggugaugauaccguguucaaugggguauuucaaugugaggauaccucuuuugcuuugggcuucaucuccuacguaagagucuuuuugucccauuccuaccauuacacccugaugucuugggcguccgacgauggaugggaauacggcacggggcgcgucauccccggcgaaaccggccuugcacauaccggauccauugucuacaacuaaagcgc

SEQ ID NO: 1495 - RNA, 352 nt, artificial sequence
  synthetic construct
guuugggucaucuuuucucuguuugccuugggguugaguggagcuucugucaggaggacgggguguucuucuggggcgacacggaguucguuguagaaggugugaugccagaucuuuuccauaucaucccaguuggugaugauaccguguucaaugggguauuucaaugugaggauaccucuuuugcuuugggcuucaucuccuacguaagagucuuuuugucccauuccuaccauuacacccugaugucuugggcguccgacgauggaugggaauacggcacggggcgcgucauccccggcgaaaccggccuugcacauaccggauccauugucuacaacuaaagcggcac

SEQ ID NO: 1496 - RNA, 350 nt, artificial sequence
  synthetic construct
gaagccaagauggauccaccgauccauacggaguauuuccuuucugggggugcgaugaucuugaucuugauggugcuuggagccaaggcggugauuucuuuuugcauccugucggcgauaccaggguacauggugguaccuccggaaaguacgguguuggcguacaaguccuuacggauaucaacgucacacuucaugauggaguuguagacgguuucguggauaccgcaagauuccauacccaagaaggaagguuggaagagggcuucuggacaacggaaucucucguuaccgauggugaugaccuguccaucgggaaguucguagcucuuuuccaaagagguugaagc

SEQ ID NO: 1497 - RNA, 352 nt, artificial sequence
  synthetic construct
gaucaacgucacacuucaugauggaguuguagacgguuucguggauaccgcaagauuccauacccaagaaggaagguuggaagagggcuucuggacaacggaaucucucguuaccgauggugaugaccuguccaucgggaaguucguagcucuuuuccaaagagguugaagcggcagcgguggccauuuccuguucgaagucgagggcgacauagcaaaguuucuccuugaugucacggacgauuucucuuucagcugugguggugaaugaguaaccucuuucggucaagauuuucaugagguagucggucaaaucacgaccagccaaguccaaacggaggauggcgugggc

SEQ ID NO: 1498 - RNA, 351 nt, artificial sequence
  synthetic construct
ggacagggaagccaagauggauccaccgauccauacggaguauuuccuuucugggggugcgaugaucuugaucuugauggugcuuggagccaaggcggugauuucuuuuugcauccugucggcgauaccaggguacauggugguaccuccggaaaguacgguguuggcguacaaguccuuacggauaucaacgucacacuucaugauggaguuguagacgguuucguggauaccgcaagauuccauacccaagaaggaagguuggaagagggcuucuggacaacggaaucucucguuaccgauggugaugaccuguccaucgggaaguucguagcucuuuuccaaagaggc

SEQ ID NO: 1499 - RNA, 351 nt, artificial sequence
  synthetic construct
guuuucucuguuugccuugggguugaguggagcuucugucaggaggacgggguguucuucuggggcgacacggaguucguuguagaaggugugaugccagaucuuuuccauaucaucccaguuggugaugauaccguguucaaugggguauuucaaugugaggauaccucuuuugcuuugggcuucaucuccuacguaagagucuuuuugucccauuccuaccauuacacccugaugucuugggcguccgacgauggaugggaauacggcacggggcgcgucauccccggcgaaaccggccuugcacauaccggauccauugucuacaacuaaagcggcaacuucuucuuc

SEQ ID NO: 1500 - RNA, 352 nt, artificial sequence
  synthetic construct
guuggauggcuacauacauggcggguguguugaagguuucaaacaugauuugggucaucuuuucucuguuugccuugggguugaguggagcuucugucaggaggacgggguguucuucuggggcgacacggaguucguuguagaaggugugaugccagaucuuuuccauaucaucccaguuggugaugauaccguguucaaugggguauuucaaugugaggauaccucuuuugcuuugggcuucaucuccuacguaagagucuuuuugucccauuccuaccauuacacccugaugucuugggcguccgacgauggaugggaauacggcacggggcgcgucauccccggcgac

SEQ ID NO: 1501 - RNA, 350 nt, artificial sequence
  synthetic construct
ggauucuugagaugcucuucaagaccugcagguccuggagcuacauucuucuuacgcagaccugaaauaucccagacccuaacuguagaauccaaugaagcagaaacuaauaaaucaucaguuggauggaauguagcacacaugacauaaugauugugaccugugaggacacaaaugcaaguccuugauugccaauuccaaauucuuauagucugaucaucagaugcagacacaauccaaggauacucaugauggaacauugugguacgaauguaaucuaaaugacccaauaacguaaaaauacaucguuuuugcuuguaguuccacaccuuuaucuuauaaucaucacc

SEQ ID NO: 1502 - RNA, 352 nt, artificial sequence
  synthetic construct
guucucaauccaaucguauccuuaccgaccucagcuaccuuacaaauauuacacaacacuccuuugaauuuaggcaaguagcugguaccgcacaacggacacuucuccuccgcuuugccccuguauaucggcguguacgaaugaccgcacaaauugaauggauugugcucgucguaaugcaguugaauaucguccgucagauuggaaucgcaggccugcaggauuuuccuagccugcugcgcgacuuccggucuaggacccaguuccagaagucuuuuggcgaacgaagcugcgguuuuauaguuuuugagcuugaaaaacauguucaaagcgguccugagggucaggauuc

SEQ ID NO: 1503 - RNA, 352 nt, artificial sequence
  synthetic construct
guucgaaucauucauucuccacaguuugauuugccuaucaucugccccagaggcuauuaaaggaaguguaggaugaaaugaagcccaguuuacaccacggucaugucccucuaaaacaugcuuaacuacagcaucagcuuguccaaauaaaucaguugaaccaggauucuugagaugcucuucaagaccugcagguccuggagcuacauucuucuuacgcagaccugaaauaucccagacccuaacuguagaauccaaugaagcagaaacuaauaaaucaucaguuggauggaauguagcacacaugacauaaugauugugaccugugaggacacaaaugcaaguccuugac

SEQ ID NO: 1504 - RNA, 352 nt, artificial sequence
  synthetic construct
guacaaauauuacacaacacuccuuugaauuuaggcaaguagcugguaccgcacaacggacacuucuccuccgcuuugccccuguauaucggcguguacgaaugaccgcacaaauugaauggauugugcucgucguaaugcaguugaauaucguccgucagauuggaaucgcaggccugcaggauuuuccuagccugcugcgcgacuuccggucuaggacccaguuccagaagucuuuuggcgaacgaagcugcgguuuuauaguuuuugagcuugaaaaacauguucaaagcgguccugagggucaggauuugauggaugggcuguaauuugcagugcgugaaguaagcgc

SEQ ID NO: 1505 - RNA, 350 nt, artificial sequence
  synthetic construct
gaaaugaugcucugaccaaccaaucgcgaauuucuaaccauguacaagacuucuucguauuugugguugauuaaagccaguuugaauuuguauucgguuggaucgaugaccaauagacgcggcuugcauucccuauccaagcaaaacacuugacuuccccucacucuaguuauguauauaggaagaucgaguguucugaugauuccgugaucgccguuuuuaaggguauacuugaugugauugcugguaguauagauaaauacaccgcuaucgucccaagcuccugauuuuacucgaguauuuucguguaaagagcacaggacgucuaauuuucuauuacaaacugucac

SEQ ID NO: 1506 - RNA, 351 nt, artificial sequence
  synthetic construct
gaaauauuacacaacacuccuuugaauuuaggcaaguagcugguaccgcacaacggacacuucuccuccgcuuugccccuguauaucggcguguacgaaugaccgcacaaauugaauggauugugcucgucguaaugcaguugaauaucguccgucagauuggaaucgcaggccugcaggauuuuccuagccugcugcgcgacuuccggucuaggacccaguuccagaagucuuuuggcgaacgaagcugcgguuuuauaguuuuugagcuugaaaaacauguucaaagcgguccugagggucaggauuugauggaugggcuguaauuugcagugcgugaaguaagcggcc

SEQ ID NO: 1507 - RNA, 352 nt, artificial sequence
  synthetic construct
guuauucucaauccaaucguauccuuaccgaccucagcuaccuuacaaauauuacacaacacuccuuugaauuuaggcaaguagcugguaccgcacaacggacacuucuccuccgcuuugccccuguauaucggcguguacgaaugaccgcacaaauugaauggauugugcucgucguaaugcaguugaauaucguccgucagauuggaaucgcaggccugcaggauuuuccuagccugcugcgcgacuuccggucuaggacccaguuccagaagucuuuuggcgaacgaagcugcgguuuuauaguuuuugagcuugaaaaacauguucaaagcgguccugagggucaggc

SEQ ID NO: 1508 - RNA, 352 nt, artificial sequence
  synthetic construct
guaaaagacauucuguauaccggaauuuuaccuccgccccugauuugcauaacgggcacgucuuuggacgugguaaagucgaguuuucucaaaaaccguucuuuuacguaguacagcagguugccguguaccguauaagcugggcguucucuuucuagcuugaagaugaccauuccaccaucauguccagcagcgaauaaauucagauuaggaugacuggucaugacccaaaaacguucauguucccuucuaaaaguaugcaaacacguccuuuuagccauaucccaaacccugauacuccuaucuucaccauuugauaguagcagcucuugccugggauggaauaauacac

SEQ ID NO: 1509 - RNA, 351 nt, artificial sequence
  synthetic construct
guucuaaccauguacaagacuucuucguauuugugguugauuaaagccaguuugaauuuguauucgguuggaucgaugaccaauagacgcggcuugcauucccuauccaagcaaaacacuugacuuccccucacucuaguuauguauauaggaagaucgaguguucugaugauuccgugaucgccguuuuuaaggguauacuugaugugauugcugguaguauagauaaauacaccgcuaucgucccaagcuccugauuuuacucgaguauuuucguguaaagagcacaggacgucuaauuuucuauuacaaacugucacauuauguuuggagagaagcgccaagugcgac

SEQ ID NO: 1510 - RNA, 351 nt, artificial sequence
  synthetic construct
gaggauucuugagaugcucuucaagaccugcagguccuggagcuacauucuucuuacgcagaccugaaauaucccagacccuaacuguagaauccaaugaagcagaaacuaauaaaucaucaguuggauggaauguagcacacaugacauaaugauugugaccugugaggacacaaaugcaaguccuugauugccaauuccaaauucuuauagucugaucaucagaugcagacacaauccaaggauacucaugauggaacauugugguacgaauguaaucuaaaugacccaauaacguaaaaauacaucguuuuugcuuguaguuccacaccuuuaucuuauaaucaucac

SEQ ID NO: 1511 - RNA, 352 nt, artificial sequence
  synthetic construct
guaguauagauaaauacaccgcuaucgucccaagcuccugauuuuacucgaguauuuucguguaaagagcacaggacgucuaauuuucuauuacaaacugucacauuauguuuggagagaagcgccaagugcgacauauccgaugaccagaccacguaucugcauuuauuuauuuuaacuugagccaaaguccuuuucuguuguacgucgaacaacguuacguguuccgaaucucuaagcaguagcaugccggugccggcauaaaaaacuucaucgcacgugggaguuuggaccuuuuuggugacuucguucuuuaaauucuugaugaucaauugguggguccuaucuaagc

SEQ ID NO: 1512 - RNA, 352 nt, artificial sequence
  synthetic construct
guaaucguaaugaugauagcucgucuaucagcuucgaacgccaaaauuucgcacauggaaucagccgugguuccaccgauugccuugcaaaaaguccagaacgcuuccaaguaggccuuguacaaaguguuucugaugauuucgauguucauuucguccaaauccuguucgcugaugcaaucuacaaagaauggagccagcggcgugucuacuaagacagcguuguauaacucugcuggcguugcggcuacguguauagcuuccauuuguucaaagcugccuaauggaugacauuuuggaaucaguucaccaauaggucuuugaugcaauguuccaguaaucaacagaauac

SEQ ID NO: 1513 - RNA, 352 nt, artificial sequence
  synthetic construct
guuucgcacauggaaucagccgugguuccaccgauugccuugcaaaaaguccagaacgcuuccaaguaggccuuguacaaaguguuucugaugauuucgauguucauuucguccaaauccuguucgcugaugcaaucuacaaagaauggagccagcggcgugucuacuaagacagcguuguauaacucugcuggcguugcggcuacguguauagcuuccauuuguucaaagcugccuaauggaugacauuuuggaaucaguucaccaauaggucuuugaugcaauguuccaguaaucaacagaauaauauugucaaucauauaacuguagguaaugaaguccaagaagguac

SEQ ID NO: 1514 - RNA, 352 nt, artificial sequence
  synthetic construct
guuacgcauaugcugaaacucgaucacaaguuuuucccucaaucuggagucgauggucgacaccgccaagggcgagggcucguuagccaagaaaguuccguaaucgguaccuuguaaaugcaguuucaaaucuucaagggucucgcacugaacuaaauuuagauagucgcuuuguuucaggauuccgcacuugaauccacgacauaauccuucuaaauauccguugucgauguuguaaagacagcccuucaugauuguaguugauuuuguaaguugucuuggagaaguacgaagaacuguacaaaaaaacucacgagaugaaaacaccucaccccaaaugucauaugauauc

SEQ ID NO: 1515 - RNA, 352 nt, artificial sequence
  synthetic construct
guuucaaguaugaauaaaacaccccaaaguggaacugcugcaugaaagcguugauguugagacgcaccucguacucgaagaacuuauccuccaaaguuuuaucgccgggauuguuuccggcgccuucaaacagcuuagaauacucagcauaauacucggcaauagcuuugaccugcucguaauccucagcucuagccagagcagcuaacccaucgggaugcagucuuccgcaacguggauacaauuuagcucuaucguccuugcuaagcuccguaccgaaagaguuaaucguaaugaugauagcucgucuaucagcuucgaacgccaaaauuucgcacauggaaucagccgc

SEQ ID NO: 1516 - RNA, 351 nt, artificial sequence
  synthetic construct
guagaaaauagggauguaauuaucaaucuuggcucuguguuuuugagccacgcacucggaaauccauacaauauuccugcacuccugcuccuugaguuucaaguaugaauaaaacaccccaaaguggaacugcugcaugaaagcguugauguugagacgcaccucguacucgaagaacuuauccuccaaaguuuuaucgccgggauuguuuccggcgccuucaaacagcuuagaauacucagcauaauacucggcaauagcuuugaccugcucguaauccucagcucuagccagagcagcuaacccaucgggaugcagucuuccgcaacguggauacaauuuagcucuauc

SEQ ID NO: 1517 - RNA, 351 nt, artificial sequence
  synthetic construct
gagggauguaauuaucaaucuuggcucuguguuuuugagccacgcacucggaaauccauacaauauuccugcacuccugcuccuugaguuucaaguaugaauaaaacaccccaaaguggaacugcugcaugaaagcguugauguugagacgcaccucguacucgaagaacuuauccuccaaaguuuuaucgccgggauuguuuccggcgccuucaaacagcuuagaauacucagcauaauacucggcaauagcuuugaccugcucguaauccucagcucuagccagagcagcuaacccaucgggaugcagucuuccgcaacguggauacaauuuagcucuaucguccuugc

SEQ ID NO: 1518 - RNA, 351 nt, artificial sequence
  synthetic construct
gauccauacaauauuccugcacuccugcuccuugaguuucaaguaugaauaaaacaccccaaaguggaacugcugcaugaaagcguugauguugagacgcaccucguacucgaagaacuuauccuccaaaguuuuaucgccgggauuguuuccggcgccuucaaacagcuuagaauacucagcauaauacucggcaauagcuuugaccugcucguaauccucagcucuagccagagcagcuaacccaucgggaugcagucuuccgcaacguggauacaauuuagcucuaucguccuugcuaagcuccguaccgaaagaguuaaucguaaugaugauagcucgucuaucagc

SEQ ID NO: 1519 - RNA, 351 nt, artificial sequence
  synthetic construct
guuucgauguucauuucguccaaauccuguucgcugaugcaaucuacaaagaauggagccagcggcgugucuacuaagacagcguuguauaacucugcuggcguugcggcuacguguauagcuuccauuuguucaaagcugccuaauggaugacauuuuggaaucaguucaccaauaggucuuugaugcaauguuccaguaaucaacagaauaauauugucaaucauauaacuguagguaaugaaguccaagaagguagacagaggcucuacggcuugauuacgcauaugcugaaacucgaucacaaguuuuucccucaaucuggagucgauggucgacaccgccaagggc

SEQ ID NO: 1520 - RNA, 352 nt, artificial sequence
  synthetic construct
guacaauauuccugcacuccugcuccuugaguuucaaguaugaauaaaacaccccaaaguggaacugcugcaugaaagcguugauguugagacgcaccucguacucgaagaacuuauccuccaaaguuuuaucgccgggauuguuuccggcgccuucaaacagcuuagaauacucagcauaauacucggcaauagcuuugaccugcucguaauccucagcucuagccagagcagcuaacccaucgggaugcagucuuccgcaacguggauacaauuuagcucuaucguccuugcuaagcuccguaccgaaagaguuaaucguaaugaugauagcucgucuaucagcuucgac

SEQ ID NO: 1521 - RNA, 352 nt, artificial sequence
  synthetic construct
gaucaucgucuuuaucuugcauuucuuuuaauuucuucuuagccaaaucuacccuguccaacuucaaaagaaugucaauaauaaaagcaugugcuuccaaacauucugacgcauguaauacuuuauaugcucccuccagauugccuucauugacguaaauaguggcagcaaccaaaaucagagugucauuauuggcauuuguggcuacuuguuggucaacuugggcuaccacugcuucuuuauuauuuuuuccugauagauaaucagcuaauaguuucagugguugaauuucgaucggagaugcuccaugaauuucaucuaauaccaccaaaaacuuauuuugugccauguc

SEQ ID NO: 1522 - RNA, 352 nt, artificial sequence
  synthetic construct
guuaaaguagcaucaucgucuuuaucuugcauuucuuuuaauuucuucuuagccaaaucuacccuguccaacuucaaaagaaugucaauaauaaaagcaugugcuuccaaacauucugacgcauguaauacuuuauaugcucccuccagauugccuucauugacguaaauaguggcagcaaccaaaaucagagugucauuauuggcauuuguggcuacuuguuggucaacuugggcuaccacugcuucuuuauuauuuuuuccugauagauaaucagcuaauaguuucagugguugaauuucgaucggagaugcuccaugaauuucaucuaauaccaccaaaaacuuauuuc

SEQ ID NO: 1523 - RNA, 352 nt, artificial sequence
  synthetic construct
guaaaugugacagcuugaccguucagaagaagugguguugaaccauauuugucaaccaauucuugguaaauguaguaagcaucuugaaguuuaucaccaccaguuugaauguugauccaagccugugccaguugaguuaaaguagcaucaucgucuuuaucuugcauuucuuuuaauuucuucuuagccaaaucuacccuguccaacuucaaaagaaugucaauaauaaaagcaugugcuuccaaacauucugacgcauguaauacuuuauaugcucccuccagauugccuucauugacguaaauaguggcagcaaccaaaaucagagugucauuauuggcauuuguggcuc

SEQ ID NO: 1524 - RNA, 352 nt, artificial sequence
  synthetic construct
guaaaguagcaucaucgucuuuaucuugcauuucuuuuaauuucuucuuagccaaaucuacccuguccaacuucaaaagaaugucaauaauaaaagcaugugcuuccaaacauucugacgcauguaauacuuuauaugcucccuccagauugccuucauugacguaaauaguggcagcaaccaaaaucagagugucauuauuggcauuuguggcuacuuguuggucaacuugggcuaccacugcuucuuuauuauuuuuuccugauagauaaucagcuaauaguuucagugguugaauuucgaucggagaugcuccaugaauuucaucuaauaccaccaaaaacuuauuuuc

SEQ ID NO: 1525 - RNA, 351 nt, artificial sequence
  synthetic construct
guagcaucaucgucuuuaucuugcauuucuuuuaauuucuucuuagccaaaucuacccuguccaacuucaaaagaaugucaauaauaaaagcaugugcuuccaaacauucugacgcauguaauacuuuauaugcucccuccagauugccuucauugacguaaauaguggcagcaaccaaaaucagagugucauuauuggcauuuguggcuacuuguuggucaacuugggcuaccacugcuucuuuauuauuuuuuccugauagauaaucagcuaauaguuucagugguugaauuucgaucggagaugcuccaugaauuucaucuaauaccaccaaaaacuuauuuugugcc

SEQ ID NO: 1526 - RNA, 351 nt, artificial sequence
  synthetic construct
gcuggauaauuggcaucuuuaucgauagccucuugcaaagcugccucugccucuucauauuuugcuugaccuauaaaugugacagcuugaccguucagaagaagugguguugaaccauauuugucaaccaauucuugguaaauguaguaagcaucuugaaguuuaucaccaccaguuugaauguugauccaagccugugccaguugaguuaaaguagcaucaucgucuuuaucuugcauuucuuuuaauuucuucuuagccaaaucuacccuguccaacuucaaaagaaugucaauaauaaaagcaugugcuuccaaacauucugacgcauguaauacuuuauaugcuccc

SEQ ID NO: 1527 - RNA, 352 nt, artificial sequence
  synthetic construct
guaaauaucuguuugcaaucucaggaccuuugcccauaugccucugaaggguaauaaaauuaaccaauguaucuggauaauuggcaucuuuaucgauagccucuugcaaagcugccucugccucuucauauuuugcuugaccuauaaaugugacagcuugaccguucagaagaagugguguugaaccauauuugucaaccaauucuugguaaauguaguaagcaucuugaaguuuaucaccaccaguuugaauguugauccaagccugugccaguugaguuaaaguagcaucaucgucuuuaucuugcauuucuuuuaauuucuucuuagccaaaucuacccuguccaacuc

SEQ ID NO: 1528 - RNA, 352 nt, artificial sequence
  synthetic construct
guuugaauguugauccaagccugugccaguugaguuaaaguagcaucaucgucuuuaucuugcauuucuuuuaauuucuucuuagccaaaucuacccuguccaacuucaaaagaaugucaauaauaaaagcaugugcuuccaaacauucugacgcauguaauacuuuauaugcucccuccagauugccuucauugacguaaauaguggcagcaaccaaaaucagagugucauuauuggcauuuguggcuacuuguuggucaacuugggcuaccacugcuucuuuauuauuuuuuccugauagauaaucagcuaauaguuucagugguugaauuucgaucggagaugcuccac

SEQ ID NO: 1529 - RNA, 351 nt, artificial sequence
  synthetic construct
guuugucaaccaauucuugguaaauguaguaagcaucuugaaguuuaucaccaccaguuugaauguugauccaagccugugccaguugaguuaaaguagcaucaucgucuuuaucuugcauuucuuuuaauuucuucuuagccaaaucuacccuguccaacuucaaaagaaugucaauaauaaaagcaugugcuuccaaacauucugacgcauguaauacuuuauaugcucccuccagauugccuucauugacguaaauaguggcagcaaccaaaaucagagugucauuauuggcauuuguggcuacuuguuggucaacuugggcuaccacugcuucuuuauuauuuuuuc

SEQ ID NO: 1530 - RNA, 351 nt, artificial sequence
  synthetic construct
guuuuaauuucuucuuagccaaaucuacccuguccaacuucaaaagaaugucaauaauaaaagcaugugcuuccaaacauucugacgcauguaauacuuuauaugcucccuccagauugccuucauugacguaaauaguggcagcaaccaaaaucagagugucauuauuggcauuuguggcuacuuguuggucaacuugggcuaccacugcuucuuuauuauuuuuuccugauagauaaucagcuaauaguuucagugguugaauuucgaucggagaugcuccaugaauuucaucuaauaccaccaaaaacuuauuuugugccauguaggaucuauaagugaagauaucuc

SEQ ID NO: 1531 - RNA, 352 nt, artificial sequence
  synthetic construct
gucaacuugggcuaccacugcuucuuuauuauuuuuuccugauagauaaucagcuaauaguuucagugguugaauuucgaucggagaugcuccaugaauuucaucuaauaccaccaaaaacuuauuuugugccauguaggaucuauaagugaagauaucucuuuggguagcaacuucuggaguugagggcuuuuuuaauuuuugagcuucguugauacauugcugguaguuuccuauauagaaauaauuuuuuauuucgaaaaguucgucuacgucuugcugcugacgugccauuuuuguuaugacguuugugugacgugugacguuuaaauaauuuuucaucuucuuguuc

SEQ ID NO: 1532 - RNA, 351 nt, artificial sequence
  synthetic construct
guacacuacuucguauuuuucuggauagagugcagucuccacggaauauuuaauaggagaaucaucaucgacaaggacuacuucgguuaucuuaauacuagcguaggaugauuuggaauugaauccgaccgacagcgggaagaaaucauugggaauggcucucggugcauugaauucuaacgacccagucuuguuacuagcgucaauaagcggcaaauuccaaaccagaugauuucuuuuagcuucauguguguauguaccaucacauucgccuacuaugggcgagcaaccgauuggcaauggaauuguaauauugacaucgaccaauuccaaauugaugugggcaaguuc

SEQ ID NO: 1533 - RNA, 352 nt, artificial sequence
  synthetic construct
guuucuugagucugucuaacagcuugauaaacuuuuucuucaugugaauccauuucgacaaaagugcggauuugagacagauugacacuuucccuauaaccuagagcuacaauuucaucaaaagcaaauauaagagaaaaggcauuuucagcuauuucauuuucaucuaaagaccuacaauauucuggaauaacucuugcaaauagacguagggucuccagaucuucuaauauauuacuagcucuaguugugaugagcaacauguauagucuuucuaaagguugauacacguaacgcacugaaucuguuucaacaaaaguguguugugucccaguuggaauuaacuuugggc

SEQ ID NO: 1534 - RNA, 351 nt, artificial sequence
  synthetic construct
gacuacuucgguuaucuuaauacuagcguaggaugauuuggaauugaauccgaccgacagcgggaagaaaucauugggaauggcucucggugcauugaauucuaacgacccagucuuguuacuagcgucaauaagcggcaaauuccaaaccagaugauuucuuuuagcuucauguguguauguaccaucacauucgccuacuaugggcgagcaaccgauuggcaauggaauuguaauauugacaucgaccaauuccaaauugaugugggcaaguucguauucgauguugacgucacaacugccgucgccagcuucugagggccaacaguugauuaauagaggcacuaaggc

SEQ ID NO: 1535 - RNA, 352 nt, artificial sequence
  synthetic construct
guuucucuuccaaucucaaguggacgucaucaauaucaguuuuaauagcaggugcuuuaguuccugguugcgagaugcuguuuuuauuuggaguuaugacguuuucuccuucagauuucaauugauccacaaaagauuccacaucucuacccuuuccgccuaguuucauaccacgagguuuuugugcagggguggcuguauaugaaggcggcuuaacaucguugaccugguuagcgauaucuccaauagauggcgucggaguauaaccgguggaacuaccaaaaccaccgcuguugcugaacgcagguuugccacccuucuuuugugcuuccauuuucugccuuugcaauuc

SEQ ID NO: 1536 - RNA, 351 nt, artificial sequence
  synthetic construct
guucucuuccaaucucaaguggacgucaucaauaucaguuuuaauagcaggugcuuuaguuccugguugcgagaugcuguuuuuauuuggaguuaugacguuuucuccuucagauuucaauugauccacaaaagauuccacaucucuacccuuuccgccuaguuucauaccacgagguuuuugugcagggguggcuguauaugaaggcggcuuaacaucguugaccugguuagcgauaucuccaauagauggcgucggaguauaaccgguggaacuaccaaaaccaccgcuguugcugaacgcagguuugccacccuucuuuugugcuuccauuuucugccuuugcaauuc

SEQ ID NO: 1537 - RNA, 352 nt, artificial sequence
  synthetic construct
guuuuucuucaugugaauccauuucgacaaaagugcggauuugagacagauugacacuuucccuauaaccuagagcuacaauuucaucaaaagcaaauauaagagaaaaggcauuuucagcuauuucauuuucaucuaaagaccuacaauauucuggaauaacucuugcaaauagacguagggucuccagaucuucuaauauauuacuagcucuaguugugaugagcaacauguauagucuuucuaaagguugauacacguaacgcacugaaucuguuucaacaaaaguguguugugucccaguuggaauuaacuuugggaaagcagcuaguagaccuucaauacgugcuuc

SEQ ID NO: 1538 - RNA, 352 nt, artificial sequence
  synthetic construct
gauuucauuuucaucuaaagaccuacaauauucuggaauaacucuugcaaauagacguagggucuccagaucuucuaauauauuacuagcucuaguugugaugagcaacauguauagucuuucuaaagguugauacacguaacgcacugaaucuguuucaacaaaaguguguugugucccaguuggaauuaacuuugggaaagcagcuaguagaccuucaauacgugcuuuggucauuucaacaaacugucuagauacaauuguuuugccugcuuucgugcagacugcugcugcaauuaguaccauuguaauuucguuuaaauggcacaaauuuacuaaaauauuauuauuc

SEQ ID NO: 1539 - RNA, 351 nt, artificial sequence
  synthetic construct
gaauuggacucguauucugccccaucuaucaucgccuaugugcaacgucgccaugccuaauauuucgaauuguugcacuccuccaucacgacccauucuggcgaucaguuucucuuccaaucucaaguggacgucaucaauaucaguuuuaauagcaggugcuuuaguuccugguugcgagaugcuguuuuuauuuggaguuaugacguuuucuccuucagauuucaauugauccacaaaagauuccacaucucuacccuuuccgccuaguuucauaccacgagguuuuugugcagggguggcuguauaugaaggcggcuuaacaucguugaccugguuagcgauaucucc

SEQ ID NO: 1540 - RNA, 352 nt, artificial sequence
  synthetic construct
guuugagacagauugacacuuucccuauaaccuagagcuacaauuucaucaaaagcaaauauaagagaaaaggcauuuucagcuauuucauuuucaucuaaagaccuacaauauucuggaauaacucuugcaaauagacguagggucuccagaucuucuaauauauuacuagcucuaguugugaugagcaacauguauagucuuucuaaagguugauacacguaacgcacugaaucuguuucaacaaaaguguguugugucccaguuggaauuaacuuugggaaagcagcuaguagaccuucaauacgugcuuuggucauuucaacaaacugucuagauacaauuguuuugc

SEQ ID NO: 1541 - RNA, 352 nt, artificial sequence
  synthetic construct
guucuucuaauaacuguuccauaguauugacaugugugcaccacagacuaagucuggauaccaugcuggauauuugagucuuguccaaaacucuagguuggacccaugucauauuuacaguacuggcaaccugaucaauagcaccuuuaacgagaccuugagaaagugccuucaugaccagaaguucaauuucauuaagagguaauuuaguuucuuuugaaauuucagcaaaaguuaguugucuguugugagauggucugcuaaaggucaucuccaucagacacaacaaagauaucuuuugucucaaaaagagcuccucagcagcuagaucugcuaugccagcccauugugc

SEQ ID NO: 1542 - RNA, 352 nt, artificial sequence
  synthetic construct
guuucauagcuucaaaucucuuuaugucaccagaauugaaagcauacaaaaguucaauuaaccaagcauuuucuguugauuucaaagagucuaacacagggugagccaguaauucuccaagauuguacacaccuucgcccaacagagcugccaaucccaaaaaaaaugcauguuguacuuugacaucggauuuuaaaguguccagcucuaugcaacccaaauaccucaaggcaguucuguaauauugugcaugguccccuugaauucgauaauauugagaggccaguaaauaaaaccugccaugcacagguguaacuccaucugcguugucuagaguggcuucgacuuccuc

SEQ ID NO: 1543 - RNA, 350 nt, artificial sequence
  synthetic construct
guguaacuccaucugcguugucuagaguggcuucgacuuccucuauaaucuuuuugguggcaucuaaaucguuuaacuuuucgagauaaauuuggcccuccaaaacuuugcagagauuuugugcaucuggauugauuuuaacuuuagguucagucuucucuaagaaagugauugcauccuuagguucuuuauauuguucgacgacaauagccgcuauuucaaccaaagacaaaggauugauuuuauuuucgaaggauugaaugaaauugugauaaaguugaauuagguugucgccuuuuuguaauuccgguuuuuuaauaaaaacgaguaauuuuaauguuaauugaugc

SEQ ID NO: 1544 - RNA, 352 nt, artificial sequence
  synthetic construct
guacaaaaguucaauuaaccaagcauuuucuguugauuucaaagagucuaacacagggugagccaguaauucuccaagauuguacacaccuucgcccaacagagcugccaaucccaaaaaaaaugcauguuguacuuugacaucggauuuuaaaguguccagcucuaugcaacccaaauaccucaaggcaguucuguaauauugugcaugguccccuugaauucgauaauauugagaggccaguaaauaaaaccugccaugcacagguguaacuccaucugcguugucuagaguggcuucgacuuccucuauaaucuuuuugguggcaucuaaaucguuuaacuuuucgagc

SEQ ID NO: 1545 - RNA, 351 nt, artificial sequence
  synthetic construct
guucauagcuucaaaucucuuuaugucaccagaauugaaagcauacaaaaguucaauuaaccaagcauuuucuguugauuucaaagagucuaacacagggugagccaguaauucuccaagauuguacacaccuucgcccaacagagcugccaaucccaaaaaaaaugcauguuguacuuugacaucggauuuuaaaguguccagcucuaugcaacccaaauaccucaaggcaguucuguaauauugugcaugguccccuugaauucgauaauauugagaggccaguaaauaaaaccugccaugcacagguguaacuccaucugcguugucuagaguggcuucgacuuccuc

SEQ ID NO: 1546 - RNA, 352 nt, artificial sequence
  synthetic construct
guuuuucuucuaauaacuguuccauaguauugacaugugugcaccacagacuaagucuggauaccaugcuggauauuugagucuuguccaaaacucuagguuggacccaugucauauuuacaguacuggcaaccugaucaauagcaccuuuaacgagaccuugagaaagugccuucaugaccagaaguucaauuucauuaagagguaauuuaguuucuuuugaaauuucagcaaaaguuaguugucuguugugagauggucugcuaaaggucaucuccaucagacacaacaaagauaucuuuugucucaaaaagagcuccucagcagcuagaucugcuaugccagcccauuc

SEQ ID NO: 1547 - RNA, 351 nt, artificial sequence
  synthetic construct
gcuucaaaucucuuuaugucaccagaauugaaagcauacaaaaguucaauuaaccaagcauuuucuguugauuucaaagagucuaacacagggugagccaguaauucuccaagauuguacacaccuucgcccaacagagcugccaaucccaaaaaaaaugcauguuguacuuugacaucggauuuuaaaguguccagcucuaugcaacccaaauaccucaaggcaguucuguaauauugugcaugguccccuugaauucgauaauauugagaggccaguaaauaaaaccugccaugcacagguguaacuccaucugcguugucuagaguggcuucgacuuccucuauaauc

SEQ ID NO: 1548 - RNA, 351 nt, artificial sequence
  synthetic construct
gacccaugucauauuuacaguacuggcaaccugaucaauagcaccuuuaacgagaccuugagaaagugccuucaugaccagaaguucaauuucauuaagagguaauuuaguuucuuuugaaauuucagcaaaaguuaguugucuguugugagauggucugcuaaaggucaucuccaucagacacaacaaagauaucuuuugucucaaaaagagcuccucagcagcuagaucugcuaugccagcccauuguguuuucauagcuucaaaucucuuuaugucaccagaauugaaagcauacaaaaguucaauuaaccaagcauuuucuguugauuucaaagagucuaacacagc

SEQ ID NO: 1549 - RNA, 352 nt, artificial sequence
  synthetic construct
guuucacuugcuuuuucuucuaauaacuguuccauaguauugacaugugugcaccacagacuaagucuggauaccaugcuggauauuugagucuuguccaaaacucuagguuggacccaugucauauuuacaguacuggcaaccugaucaauagcaccuuuaacgagaccuugagaaagugccuucaugaccagaaguucaauuucauuaagagguaauuuaguuucuuuugaaauuucagcaaaaguuaguugucuguugugagauggucugcuaaaggucaucuccaucagacacaacaaagauaucuuuugucucaaaaagagcuccucagcagcuagaucugcuaugc

SEQ ID NO: 1550 - RNA, 351 nt, artificial sequence
  synthetic construct
guuugucucaaaaagagcuccucagcagcuagaucugcuaugccagcccauuguguuuucauagcuucaaaucucuuuaugucaccagaauugaaagcauacaaaaguucaauuaaccaagcauuuucuguugauuucaaagagucuaacacagggugagccaguaauucuccaagauuguacacaccuucgcccaacagagcugccaaucccaaaaaaaaugcauguuguacuuugacaucggauuuuaaaguguccagcucuaugcaacccaaauaccucaaggcaguucuguaauauugugcaugguccccuugaauucgauaauauugagaggccaguaaauaaaac

SEQ ID NO: 1551 - RNA, 352 nt, artificial sequence
  synthetic construct
guggcccuccaaaacuuugcagagauuuugugcaucuggauugauuuuaacuuuagguucagucuucucuaagaaagugauugcauccuuagguucuuuauauuguucgacgacaauagccgcuauuucaaccaaagacaaaggauugauuuuauuuucgaaggauugaaugaaauugugauaaaguugaauuagguugucgccuuuuuguaauuccgguuuuuuaauaaaaacgaguaauuuuaauguuaauugaugccauaauuuuuuauuaugaaguuccucgaguucggcccauucggaaccuaauucuuuuggacuuucuuguuguuuuuuagauagauaaucacuc

SEQ ID NO: 1552 - RNA, 351 nt, artificial sequence
  synthetic construct
guaaucucuucuucguccuccucuuccgguuccuccacagaggucgcugguaacggcgauacuuucucugcggcgucuugaggcggcagaggggcuucuccuaucuuucccuccguuaucucgaacaaaacuuugucgaucuccgucugcgccgccuccuccauuuccucggaauaaucaaggucuuccaugguuucguccaacauuucuucgauuauacccgccuucaucaucucuuucgacaugucuugcauuguuugggcuaccucgggcacucuaacgagucgcugcaucgcuugcaucaccucuguagacuucuggagggcgccugacacucucaauguagcuaac

SEQ ID NO: 1553 - RNA, 352 nt, artificial sequence
  synthetic construct
guaaucgacucugcauuuccguaaucucuucuucguccuccucuuccgguuccuccacagaggucgcugguaacggcgauacuuucucugcggcgucuugaggcggcagaggggcuucuccuaucuuucccuccguuaucucgaacaaaacuuugucgaucuccgucugcgccgccuccuccauuuccucggaauaaucaaggucuuccaugguuucguccaacauuucuucgauuauacccgccuucaucaucucuuucgacaugucuugcauuguuugggcuaccucgggcacucuaacgagucgcugcaucgcuugcaucaccucuguagacuucuggagggcgccugc

SEQ ID NO: 1554 - RNA, 352 nt, artificial sequence
  synthetic construct
guuuccguaaucucuucuucguccuccucuuccgguuccuccacagaggucgcugguaacggcgauacuuucucugcggcgucuugaggcggcagaggggcuucuccuaucuuucccuccguuaucucgaacaaaacuuugucgaucuccgucugcgccgccuccuccauuuccucggaauaaucaaggucuuccaugguuucguccaacauuucuucgauuauacccgccuucaucaucucuuucgacaugucuugcauuguuugggcuaccucgggcacucuaacgagucgcugcaucgcuugcaucaccucuguagacuucuggagggcgccugacacucucaauguac

SEQ ID NO: 1555 - RNA, 352 nt, artificial sequence
  synthetic construct
gaccucuguagacuucuggagggcgccugacacucucaauguagcuaacugguucuucauuugcaacaucacagaauugaggugagccuucgacguguaaauuuuauuaacagcuuuccuugaauuaauaauuuccuuggccaaaauaaggcagguguccuugucguuuuucuucgcugcaucuuuuaaagaccuuuucacuuuuuccucuucucuuuguauagcuuuaauuugccuaucuaauugguaucccucuuugcgaaguuugugauuccauucuguaaccaaaucuuuaggauuccuuucaggugucuucccaaaaagucccauguuuauuacagauguuuuucuc

SEQ ID NO: 1556 - RNA, 352 nt, artificial sequence
  synthetic construct
gaaucucuucuucguccuccucuuccgguuccuccacagaggucgcugguaacggcgauacuuucucugcggcgucuugaggcggcagaggggcuucuccuaucuuucccuccguuaucucgaacaaaacuuugucgaucuccgucugcgccgccuccuccauuuccucggaauaaucaaggucuuccaugguuucguccaacauuucuucgauuauacccgccuucaucaucucuuucgacaugucuugcauuguuugggcuaccucgggcacucuaacgagucgcugcaucgcuugcaucaccucuguagacuucuggagggcgccugacacucucaauguagcuaacuc

SEQ ID NO: 1557 - RNA, 351 nt, artificial sequence
  synthetic construct
guuucuucgauuauacccgccuucaucaucucuuucgacaugucuugcauuguuugggcuaccucgggcacucuaacgagucgcugcaucgcuugcaucaccucuguagacuucuggagggcgccugacacucucaauguagcuaacugguucuucauuugcaacaucacagaauugaggugagccuucgacguguaaauuuuauuaacagcuuuccuugaauuaauaauuuccuuggccaaaauaaggcagguguccuugucguuuuucuucgcugcaucuuuuaaagaccuuuucacuuuuuccucuucucuuuguauagcuuuaauuugccuaucuaauugguauccc

SEQ ID NO: 1558 - RNA, 352 nt, artificial sequence
  synthetic construct
guaaucaaggucuuccaugguuucguccaacauuucuucgauuauacccgccuucaucaucucuuucgacaugucuugcauuguuugggcuaccucgggcacucuaacgagucgcugcaucgcuugcaucaccucuguagacuucuggagggcgccugacacucucaauguagcuaacugguucuucauuugcaacaucacagaauugaggugagccuucgacguguaaauuuuauuaacagcuuuccuugaauuaauaauuuccuuggccaaaauaaggcagguguccuugucguuuuucuucgcugcaucuuuuaaagaccuuuucacuuuuuccucuucucuuuguauc

SEQ ID NO: 1559 - RNA, 351 nt, artificial sequence
  synthetic construct
gucucguuggaaacgaauuaauuuuauugauucgucgcacauugagacauauaaaucuuugcgaccuuuuuuguaagccuccaaugccgaggugagaagggcgucuuucaugugauuuuucuuaucgucuaaacugucaaggauaaacaucucggcuugggcgcagaaaucaucuucuugaauguauauuucacuuaaagcuuggguauuaugcucuuugcaguauuuaauaaacagggauugagcuacaggaaaauuucuaauagucaucuuaaagucucccaacggcauauuuucucuuaauuucaauauaaccauauacacuaaaucuguaucuccacuuucaaucgc

SEQ ID NO: 1560 - RNA, 351 nt, artificial sequence
  synthetic construct
guugagacauauaaaucuuugcgaccuuuuuuguaagccuccaaugccgaggugagaagggcgucuuucaugugauuuuucuuaucgucuaaacugucaaggauaaacaucucggcuugggcgcagaaaucaucuucuugaauguauauuucacuuaaagcuuggguauuaugcucuuugcaguauuuaauaaacagggauugagcuacaggaaaauuucuaauagucaucuuaaagucucccaacggcauauuuucucuuaauuucaauauaaccauauacacuaaaucuguaucuccacuuucaaucgccuuaacuaacgcugguacguuuucuccuaauucuaaaagc

SEQ ID NO: 1561 - RNA, 351 nt, artificial sequence
  synthetic construct
gaauuuuugaccguguuuaccaacuauuaaaaaaguguugucuuuuucccaauacagaacaacagccucauuaccacaccaaaguaaauguuuuggucuaaaaaccaugucacaaucgauuucgcaguauuuuguccucaaauuuguggaacccaaccacaaaaauccagaauccguaaacaacgccagauggugugcauuuaaugaaacagacauuuuuaugauugauguguauuuguuggugauauccgguucaagcauugcacuugugugguguucaucuuguuucagucuauagaguucuacacuucuugcuauuaaaacuucagucuuaucaucagaaacuauagc

SEQ ID NO: 1562 - RNA, 351 nt, artificial sequence
  synthetic construct
guuuauccucuacgucucguuggaaacgaauuaauuuuauugauucgucgcacauugagacauauaaaucuuugcgaccuuuuuuguaagccuccaaugccgaggugagaagggcgucuuucaugugauuuuucuuaucgucuaaacugucaaggauaaacaucucggcuugggcgcagaaaucaucuucuugaauguauauuucacuuaaagcuuggguauuaugcucuuugcaguauuuaauaaacagggauugagcuacaggaaaauuucuaauagucaucuuaaagucucccaacggcauauuuucucuuaauuucaauauaaccauauacacuaaaucuguaucuc

SEQ ID NO: 1563 - RNA, 351 nt, artificial sequence
  synthetic construct
gacuuuauccucuacgucucguuggaaacgaauuaauuuuauugauucgucgcacauugagacauauaaaucuuugcgaccuuuuuuguaagccuccaaugccgaggugagaagggcgucuuucaugugauuuuucuuaucgucuaaacugucaaggauaaacaucucggcuugggcgcagaaaucaucuucuugaauguauauuucacuuaaagcuuggguauuaugcucuuugcaguauuuaauaaacagggauugagcuacaggaaaauuucuaauagucaucuuaaagucucccaacggcauauuuucucuuaauuucaauauaaccauauacacuaaaucuguauc

SEQ ID NO: 1564 - RNA, 352 nt, artificial sequence
  synthetic construct
guaucagaucucaugucuggaaugaagcauuuaccaaauugugcugcucuuauuaacaauuuuugaacgucagugucaaauucauauccuacugcuucuauacacugguugacugcagucuccagaucauuuuuaacuaaacaaauguauucauuugcuuuauggcuaccuuuuugaaauuguuuugaggcuucuaacagaaaacuaccagggucugugcuguuaauucuaaaaaucuuuugaacaacuucugguacuuuuugaaguaguucauguugcguauucgaaauuauccuaauaccaucuauuucugguaccaaaugaaccgauccaucauaaaaguaacuuaauc

SEQ ID NO: 1565 - RNA, 351 nt, artificial sequence
  synthetic construct
guagucaucuuaaagucucccaacggcauauuuucucuuaauuucaauauaaccauauacacuaaaucuguaucuccacuuucaaucgccuuaacuaacgcugguacguuuucuccuaauucuaaaagcaguuuuacuuggucgcuugcuuuagacucguaaucuagaagcuuuauagccaauuuuuuucucccauauucugaagcaguacuggcaauuucacuguaagaaaugccugaagaguaccccaacuuuucagcaauuucccuagcuaccguuucuuccucuaaaugugacuggcugaccuuauauuuugcccaguggaccaaaauauagcuuguuccgucuucc

SEQ ID NO: 1566 - RNA, 352 nt, artificial sequence
  synthetic construct
guucaauacucucaaaagucuacacauauuuacauaacuaucagaucucaugucuggaaugaagcauuuaccaaauugugcugcucuuauuaacaauuuuugaacgucagugucaaauucauauccuacugcuucuauacacugguugacugcagucuccagaucauuuuuaacuaaacaaauguauucauuugcuuuauggcuaccuuuuugaaauuguuuugaggcuucuaacagaaaacuaccagggucugugcuguuaauucuaaaaaucuuuugaacaacuucugguacuuuuugaaguaguucauguugcguauucgaaauuauccuaauaccaucuauuucuggc

SEQ ID NO: 1567 - RNA, 352 nt, artificial sequence
  synthetic construct
gucuuguauacaaagaaguucuucaucauuuguccagcccaugugaacaaugggccgucuacuccacuugaaugaagcuaucuguuugccagauccagaaaaaauggaaauaauugguuguccagaccccugcacuuuaagaaucuuuuggucaucucuucuaauggcuauagggccuccguaagaagccgaagaugcuauauaauucucuauauuaacuucuugaugccaugacauagaauauauuucaaauuuucuguaauaugcaucucuucccaguaagaaccauucugccguuagcauugcagcagacauuuugauaaaaauuaaaggaaaauaauuguaauauauc

SEQ ID NO: 1568 - RNA, 351 nt, artificial sequence
  synthetic construct
guaugcucuuugcaguauuuaauaaacagggauugagcuacaggaaaauuucuaauagucaucuuaaagucucccaacggcauauuuucucuuaauuucaauauaaccauauacacuaaaucuguaucuccacuuucaaucgccuuaacuaacgcugguacguuuucuccuaauucuaaaagcaguuuuacuuggucgcuugcuuuagacucguaaucuagaagcuuuauagccaauuuuuuucucccauauucugaagcaguacuggcaauuucacuguaagaaaugccugaagaguaccccaacuuuucagcaauuucccuagcuaccguuucuuccucuaaaugugac

SEQ ID NO: 1569 - RNA, 352 nt, artificial sequence
  synthetic construct
guuucuuaucgucuaaacugucaaggauaaacaucucggcuugggcgcagaaaucaucuucuugaauguauauuucacuuaaagcuuggguauuaugcucuuugcaguauuuaauaaacagggauugagcuacaggaaaauuucuaauagucaucuuaaagucucccaacggcauauuuucucuuaauuucaauauaaccauauacacuaaaucuguaucuccacuuucaaucgccuuaacuaacgcugguacguuuucuccuaauucuaaaagcaguuuuacuuggucgcuugcuuuagacucguaaucuagaagcuuuauagccaauuuuuuucucccauauucugaagc

SEQ ID NO: 1570 - RNA, 350 nt, artificial sequence
  synthetic construct
guagcccuaggguguaaccuagcauagcauuugcgacagaucaucuugucgcaguuguauuucugagcuaggagacgcagagagggcucgaugauaccuccucucaaacggagcaccaaaugaaggguggauucuuucuggauauuauagucugaaagaguacguccaucuucgaguuguuuuccagcgaagauuaaucgcugcuggucaggagggauaccuuccuuguccuggaucuuugcuuuuacauuuucuauaguaucugauggcucuaccucgaggguaaugguuuuaccugugagaguuuucacgaaaauuugcauuguggaaggugguguuccgcaacgugc

SEQ ID NO: 1571 - RNA, 351 nt, artificial sequence
  synthetic construct
guacuucagcuucuucuuggggcgcaaguuguuuguguguccacacuugguuuuccugcaauuaguagcccuaggguguaaccuagcauagcauuugcgacagaucaucuugucgcaguuguauuucugagcuaggagacgcagagagggcucgaugauaccuccucucaaacggagcaccaaaugaaggguggauucuuucuggauauuauagucugaaagaguacguccaucuucgaguuguuuuccagcgaagauuaaucgcugcuggucaggagggauaccuuccuuguccuggaucuuugcuuuuacauuuucuauaguaucugauggcucuaccucgaggguaac

SEQ ID NO: 1572 - RNA, 352 nt, artificial sequence
  synthetic construct
guuuuccugcaauuaguagcccuaggguguaaccuagcauagcauuugcgacagaucaucuugucgcaguuguauuucugagcuaggagacgcagagagggcucgaugauaccuccucucaaacggagcaccaaaugaaggguggauucuuucuggauauuauagucugaaagaguacguccaucuucgaguuguuuuccagcgaagauuaaucgcugcuggucaggagggauaccuuccuuguccuggaucuuugcuuuuacauuuucuauaguaucugauggcucuaccucgaggguaaugguuuuaccugugagaguuuucacgaaaauuugcauuguggaaggugguc

SEQ ID NO: 1573 - RNA, 352 nt, artificial sequence
  synthetic construct
guucuuccuuaacucuauccuucuugagcggacccaugaaggcggccuuaucggcggcggucuggaaucuaccguguccaaauuuagacgagguaucaaugaauuucaaauugaucuucuccaaagcgacacguuugguguggaccaacaaggacuuucugagggugaugacacgcuucuuggguccuauacaacaucccuugaucaugacgaagucauuguucacuucaccauagugagggaaaccucccauuggaguaaugguuuucucacuaagaucauaagcaguggaagcauuguucuugacgaccuuuccaucuuugguguggauuccggcuccgauucuguaaac

SEQ ID NO: 1574 - RNA, 352 nt, artificial sequence
  synthetic construct
guuaucuucuuccuuaacucuauccuucuugagcggacccaugaaggcggccuuaucggcggcggucuggaaucuaccguguccaaauuuagacgagguaucaaugaauuucaaauugaucuucuccaaagcgacacguuugguguggaccaacaaggacuuucugagggugaugacacgcuucuuggguccuauacaacaucccuugaucaugacgaagucauuguucacuucaccauagugagggaaaccucccauuggaguaaugguuuucucacuaagaucauaagcaguggaagcauuguucuugacgaccuuuccaucuuugguguggauuccggcuccgauucuc

SEQ ID NO: 1575 - RNA, 352 nt, artificial sequence
  synthetic construct
guuccuuaacucuauccuucuugagcggacccaugaaggcggccuuaucggcggcggucuggaaucuaccguguccaaauuuagacgagguaucaaugaauuucaaauugaucuucuccaaagcgacacguuugguguggaccaacaaggacuuucugagggugaugacacgcuucuuggguccuauacaacaucccuugaucaugacgaagucauuguucacuucaccauagugagggaaaccucccauuggaguaaugguuuucucacuaagaucauaagcaguggaagcauuguucuugacgaccuuuccaucuuugguguggauuccggcuccgauucuguaaaucuc

SEQ ID NO: 1576 - RNA, 352 nt, artificial sequence
  synthetic construct
gucucacuaagaucauaagcaguggaagcauuguucuugacgaccuuuccaucuuugguguggauuccggcuccgauucuguaaaucuucuuguucaucucaguucugugaugguaaccuuucugaccagcacgggcuacggugaacgauacacgagaaggaugccacgcuccaauacaagcaacuuuacgaagacccuugugcguuuugcggggcaacuucuuugugugccaacgagaaguaacaccuuuguauccaugacccuuggugacaccaaugcagucaaucaucucaucuugggcaaagacguuggcaacagggauugguuuuucaagauguucccuggcccauc

SEQ ID NO: 1577 - RNA, 352 nt, artificial sequence
  synthetic construct
gaugaucuucuucaagucgcguucaauggacuucuuaccuagaucaucaguccauuucuuagaugccuuagugaaggccuucuuuuugcucuuguaccaguucuuguagaagcgucugcgacagucuucagauaaaugcucagcccaaacuguggccaaagcccuaagaccauguggaguuucaauauaaccaacuacuccuacaacaaccauuggaggaguuuccaaaaugguaacagccucuacgauuucuuucuuauuuauuuuugaaccgggccugucugcuucucuuacaacgugggucauaccagcuuuauaaccgauaaaagcgguuaaauggacagguuucgac

SEQ ID NO: 1578 - RNA, 352 nt, artificial sequence
  synthetic construct
guaucuucuuccuuaacucuauccuucuugagcggacccaugaaggcggccuuaucggcggcggucuggaaucuaccguguccaaauuuagacgagguaucaaugaauuucaaauugaucuucuccaaagcgacacguuugguguggaccaacaaggacuuucugagggugaugacacgcuucuuggguccuauacaacaucccuugaucaugacgaagucauuguucacuucaccauagugagggaaaccucccauuggaguaaugguuuucucacuaagaucauaagcaguggaagcauuguucuugacgaccuuuccaucuuugguguggauuccggcuccgauucugc

SEQ ID NO: 1579 - RNA, 351 nt, artificial sequence
  synthetic construct
guaaugaucuucuucaagucgcguucaauggacuucuuaccuagaucaucaguccauuucuuagaugccuuagugaaggccuucuuuuugcucuuguaccaguucuuguagaagcgucugcgacagucuucagauaaaugcucagcccaaacuguggccaaagcccuaagaccauguggaguuucaauauaaccaacuacuccuacaacaaccauuggaggaguuuccaaaaugguaacagccucuacgauuucuuucuuauuuauuuuugaaccgggccugucugcuucucuuacaacgugggucauaccagcuuuauaaccgauaaaagcgguuaaauggacagguuuc

SEQ ID NO: 1580 - RNA, 350 nt, artificial sequence
  synthetic construct
gauguucccuggcccaugcaaccuuaucggcuacgguuccaccguuaaguugaauuuccaugaugugggcuuucuuuugacguuguuucaacaauuucaucugagugugagcaaccacccugacaaccuugcaguacuuaaugaucuucuucaagucgcguucaauggacuucuuaccuagaucaucaguccauuucuuagaugccuuagugaaggccuucuuuuugcucuuguaccaguucuuguagaagcgucugcgacagucuucagauaaaugcucagcccaaacuguggccaaagcccuaagaccauguggaguuucaauauaaccaacuacuccuacaacaacc

SEQ ID NO: 1581 - RNA, 351 nt, artificial sequence
  synthetic construct
guuuucaagauguucccuggcccaugcaaccuuaucggcuacgguuccaccguuaaguugaauuuccaugaugugggcuuucuuuugacguuguuucaacaauuucaucugagugugagcaaccacccugacaaccuugcaguacuuaaugaucuucuucaagucgcguucaauggacuucuuaccuagaucaucaguccauuucuuagaugccuuagugaaggccuucuuuuugcucuuguaccaguucuuguagaagcgucugcgacagucuucagauaaaugcucagcccaaacuguggccaaagcccuaagaccauguggaguuucaauauaaccaacuacuccuac

SEQ ID NO: 1582 - RNA, 351 nt, artificial sequence
  synthetic construct
gaucugagugugagcaaccacccugacaaccuugcaguacuuaaugaucuucuucaagucgcguucaauggacuucuuaccuagaucaucaguccauuucuuagaugccuuagugaaggccuucuuuuugcucuuguaccaguucuuguagaagcgucugcgacagucuucagauaaaugcucagcccaaacuguggccaaagcccuaagaccauguggaguuucaauauaaccaacuacuccuacaacaaccauuggaggaguuuccaaaaugguaacagccucuacgauuucuuucuuauuuauuuuugaaccgggccugucugcuucucuuacaacgugggucauacc

SEQ ID NO: 1583 - RNA, 352 nt, artificial sequence
  synthetic construct
guucuuguucaucucaguucugugaugguaaccuuucugaccagcacgggcuacggugaacgauacacgagaaggaugccacgcuccaauacaagcaacuuuacgaagacccuugugcguuuugcggggcaacuucuuugugugccaacgagaaguaacaccuuuguauccaugacccuuggugacaccaaugcagucaaucaucucaucuugggcaaagacguuggcaacagggauugguuuuucaagauguucccuggcccaugcaaccuuaucggcuacgguuccaccguuaaguugaauuuccaugaugugggcuuucuuuugacguuguuucaacaauuucaucugc

SEQ ID NO: 1584 - RNA, 351 nt, artificial sequence
  synthetic construct
guuucaacaacuauagcaccuucuaguuugcuuuguagcuucuuuuuaucaggaucgucaucuucaucacuaucacucuuuuugucuucuuuggaggagccuccaucuaauacuggcuucuuuuuaguuuuccuuauagauucuuuaauuuuuucagcccuuucuagauauuguacacacuuagcccuaauacuuuccuuagccuuuucucccugagcuucauacuuuauggcaugaagaaaauauucuacaccauguucauacaaacgaagagcuucuucauaauuuuuauuccuauccucuucgguggcuuuaguuacuaguucuauagcuuuuuguaaaguaguuccc

SEQ ID NO: 1585 - RNA, 350 nt, artificial sequence
  synthetic construct
gcaccuucuaguuugcuuuguagcuucuuuuuaucaggaucgucaucuucaucacuaucacucuuuuugucuucuuuggaggagccuccaucuaauacuggcuucuuuuuaguuuuccuuauagauucuuuaauuuuuucagcccuuucuagauauuguacacacuuagcccuaauacuuuccuuagccuuuucucccugagcuucauacuuuauggcaugaagaaaauauucuacaccauguucauacaaacgaagagcuucuucauaauuuuuauuccuauccucuucgguggcuuuaguuacuaguucuauagcuuuuuguaaaguaguucccguagccauuugaac

SEQ ID NO: 1586 - RNA, 351 nt, artificial sequence
  synthetic construct
guuuucaacaacuauagcaccuucuaguuugcuuuguagcuucuuuuuaucaggaucgucaucuucaucacuaucacucuuuuugucuucuuuggaggagccuccaucuaauacuggcuucuuuuuaguuuuccuuauagauucuuuaauuuuuucagcccuuucuagauauuguacacacuuagcccuaauacuuuccuuagccuuuucucccugagcuucauacuuuauggcaugaagaaaauauucuacaccauguucauacaaacgaagagcuucuucauaauuuuuauuccuauccucuucgguggcuuuaguuacuaguucuauagcuuuuuguaaaguaguucc

SEQ ID NO: 1587 - RNA, 351 nt, artificial sequence
  synthetic construct
guucuucugucaacucuguguggguauuuccuaaauguaauuugaacaugacagcucucgccgguucuuccgguagcgguauguaaauccuuuuuucgaaacgucuccugauggcggaaucuaauacccaaggaauauuaguagcuccuaacacuaagauacccucgguaucauggccaacaccuugcauuugaacuaaaaauuccgucuugauucuccuggcugauucagauucauuaucagaacgugacgaacaaagugaaucgauuucgucaaugaauaugaugcuggguuugugaguucuggccaacucgaacaaguucuugaccaauuucucagauucacccaacc

SEQ ID NO: 1588 - RNA, 352 nt, artificial sequence
  synthetic construct
guucuuguccgaaaucuuccauaaacuuccucaauuucguaagauccucaucauugacggugggcuucgaggugccaacugaucucaacaugucauucaaaguaaccgguggcucugcuaauuuuucgcucggaauauccauccaggacauuucuauugcaccagaaucaccgggcgagcaagguaugaguaaaucauccacuaugguauugggaucgacuggugaugguccccuaauccucuuaaagugggucgcgguuugaacuuuacgcacuggcugcaucagagcgucacguaccacgauacuaauaucagcaccagaguaaccuucaguuuuggaagccaacucuuc

SEQ ID NO: 1589 - RNA, 351 nt, artificial sequence
  synthetic construct
guuaauguccuuuagaggacguugaauaccaucaaaaauggaacccauaauaccagguccaaguucuacugauagagguuugccgguucucaauacagggucgccgacuguuacaccagaaguuucuucauauaccuggauaguugccauaucacccuccaaucgaauaauuucuccuacaagcucauaguacccuacacguacuaauucguacauagcagauccagacauuuuuucagcagugacgacuggaccggacacggcauggacauauccauacuggcccucuuuuucuucgucuccaacccggacucuagacauuuuuguggauguuauguaucuauugcaacc

SEQ ID NO: 1590 - RNA, 352 nt, artificial sequence
  synthetic construct
guuggauaucuucauacagcuggucaaaaucggcuuugauuuucgcuucgccgucuuuaacgggaucuuuaaacuucauacugcucaauugguacaaaauguugcucaucgaaucccugaucacguuccacgugaucuuguucucggacugagccgucgauucuacggcgugucuagccaugucguacaugccgaucauguucuugagcauuccgacgguuuuguagaacgggcaaaaacgaucguaggacgaguaggaguuuuguuggaggaaaucuucuuucaacagcuuggcgauuuccaaagugauuuugucagcuucggccaacgaugcuuuuccuacuaguugcac

SEQ ID NO: 1591 - RNA, 352 nt, artificial sequence
  synthetic construct
guuuccaauacaacuucaucaacuguguaauuuccugggucugcaacauauguuacaguucccuuagcuuuagguggaagagucauuuuaagcuucacaagaguguuuucaugaaccauaccauagaugucaccgccggucaaaugagaucccaacuugauguugaugggugcgaauucccacuuugccguucuggaaagugcuggaacauuuacaccuuucggaauguaaauacuuugaguuaagucguuaauguccuuuagaggacguugaauaccaucaaaaauggaacccauaauaccagguccaaguucuacugauagagguuugccgguucucaauacagggucgc

SEQ ID NO: 1592 - RNA, 352 nt, artificial sequence
  synthetic construct
guuucacuaacaggucuggcuugacguaccggccacacuugcaacaugguguauuuugugcguucuccaucaaauucaguuuccaauacaacuucaucaacuguguaauuuccugggucugcaacauauguuacaguucccuuagcuuuagguggaagagucauuuuaagcuucacaagaguguuuucaugaaccauaccauagaugucaccgccggucaaaugagaucccaacuugauguugaugggugcgaauucccacuuugccguucuggaaagugcuggaacauuuacaccuuucggaauguaaauacuuugaguuaagucguuaauguccuuuagaggacguugac

SEQ ID NO: 1593 - RNA, 352 nt, artificial sequence
  synthetic construct
guacaacuucaucaacuguguaauuuccugggucugcaacauauguuacaguucccuuagcuuuagguggaagagucauuuuaagcuucacaagaguguuuucaugaaccauaccauagaugucaccgccggucaaaugagaucccaacuugauguugaugggugcgaauucccacuuugccguucuggaaagugcuggaacauuuacaccuuucggaauguaaauacuuugaguuaagucguuaauguccuuuagaggacguugaauaccaucaaaaauggaacccauaauaccagguccaaguucuacugauagagguuugccgguucucaauacagggucgccgacugc

SEQ ID NO: 1594 - RNA, 351 nt, artificial sequence
  synthetic construct
gaaauguugcucaucgaaucccugaucacguuccacgugaucuuguucucggacugagccgucgauucuacggcgugucuagccaugucguacaugccgaucauguucuugagcauuccgacgguuuuguagaacgggcaaaaacgaucguaggacgaguaggaguuuuguuggaggaaaucuucuuucaacagcuuggcgauuuccaaagugauuuugucagcuucggccaacgaugcuuuuccuacuaguugcacgauuucugugagaucgucuucuuccugaagaauuuccuuaacuuuaguucuaagggguaugaauucggcaaaguuuuugucauagaaaucgucc

SEQ ID NO: 1595 - RNA, 352 nt, artificial sequence
  synthetic construct
guuucuaccgucaauucagggaagucccgcaauacuucagacauuucauuaccucuuucuccacaaccuacguagacaaugacaucagaauuggaguauuuggagagcgacugugaaauuacaguuuuuccacaaccaaaggcaccgggaauagcaguaguaccgcccugaacacaagggaagagggcauccaauacacguuguccgguaaguaggggaugauuggccggcaauuuuucacuaacaggucuggcuugacguaccggccacacuugcaacaugguguauuuugugcguucuccaucaaauucaguuuccaauacaacuucaucaacuguguaauuuccugggc

SEQ ID NO: 1596 - RNA, 352 nt, artificial sequence
  synthetic construct
guuucauuaccucuuucuccacaaccuacguagacaaugacaucagaauuggaguauuuggagagcgacugugaaauuacaguuuuuccacaaccaaaggcaccgggaauagcaguaguaccgcccugaacacaagggaagagggcauccaauacacguuguccgguaaguaggggaugauuggccggcaauuuuucacuaacaggucuggcuugacguaccggccacacuugcaacaugguguauuuugugcguucuccaucaaauucaguuuccaauacaacuucaucaacuguguaauuuccugggucugcaacauauguuacaguucccuuagcuuuagguggaagac

SEQ ID NO: 1597 - RNA, 352 nt, artificial sequence
  synthetic construct
gucuuuaaacuucauacugcucaauugguacaaaauguugcucaucgaaucccugaucacguuccacgugaucuuguucucggacugagccgucgauucuacggcgugucuagccaugucguacaugccgaucauguucuugagcauuccgacgguuuuguagaacgggcaaaaacgaucguaggacgaguaggaguuuuguuggaggaaaucuucuuucaacagcuuggcgauuuccaaagugauuuugucagcuucggccaacgaugcuuuuccuacuaguugcacgauuucugugagaucgucuucuuccugaagaauuuccuuaacuuuaguucuaagggguaugaac

SEQ ID NO: 1598 - RNA, 351 nt, artificial sequence
  synthetic construct
gacgugaucuuguucucggacugagccgucgauucuacggcgugucuagccaugucguacaugccgaucauguucuugagcauuccgacgguuuuguagaacgggcaaaaacgaucguaggacgaguaggaguuuuguuggaggaaaucuucuuucaacagcuuggcgauuuccaaagugauuuugucagcuucggccaacgaugcuuuuccuacuaguugcacgauuucugugagaucgucuucuuccugaagaauuuccuuaacuuuaguucuaagggguaugaauucggcaaaguuuuugucauagaaaucguccaaugcccucaaauauuuggaauaugaacugagc

SEQ ID NO: 1599 - RNA, 351 nt, artificial sequence
  synthetic construct
gucauuuuaagcuucacaagaguguuuucaugaaccauaccauagaugucaccgccggucaaaugagaucccaacuugauguugaugggugcgaauucccacuuugccguucuggaaagugcuggaacauuuacaccuuucggaauguaaauacuuugaguuaagucguuaauguccuuuagaggacguugaauaccaucaaaaauggaacccauaauaccagguccaaguucuacugauagagguuugccgguucucaauacagggucgccgacuguuacaccagaaguuucuucauauaccuggauaguugccauaucacccuccaaucgaauaauuucuccuacaagc

SEQ ID NO: 1600 - RNA, 352 nt, artificial sequence
  synthetic construct
guuucaauaauucucaaugcaguaacuauuacuguaggaucuuuucuuacaguauuuaauguucuauauaaaauaauaguuaacuguuuuucuaguaagcuggauaguacuucuacaucagcaaaauaugcuuuuaacauugauuuaucauguacagauugguuagguaauuugugaagcucaaauaguaagucaucucuugaauuuuccaagucucucaagcacugauguguaugaaguaacuuuccuucauuaauccaggauuuugucuuuucuacacuuucugggacuguaaaaauauguuucagauuuucuuuggcuguuacauauugcgaaugccucauauuuucac

SEQ ID NO: 1601 - RNA, 351 nt, artificial sequence
  synthetic construct
gcacuauaguucgcuucaauauucuuaagauagucuucuucuaaucugucuauaacagcagauggaaguaaaggagguaaauuuucaguagaggucacuaaaucagggugaccuaacaugucuuuggcucgauaaguuuuaagaacccaagacagcauuguaacauauucauuaccuugaaggccauuuuguauaauuuccugcagauguacggaaaggcauccaugguagauaugaauauauuuaucuaauauuuuauaacuuggaggaaagcacgguaagcaaagaguuuugacaauucuuaaaucuucuaaaaucaucauucuaauaaguucuaaauaucuuaucagc

SEQ ID NO: 1602 - RNA, 352 nt, artificial sequence
  synthetic construct
guacaaaaaguucuucuagcaaguacaugacugcgucauuccucaauuuaauauaaguacuuuuuaacaugccaaaauucuugguaaguucaugugaacuguuauuaguaacauacuguuuuucuaauugacaccccaacuccacaaguuguaaaguauuauuuacuauuaaaaucauauacugggugaaauaaacgacuuguuuccuguccucaaaauauuuguucuuaaauucaauaauagcaucccugaaagcaucugcgaauauuauaacuugucuaaugcuuaaauucaagcauuuaaauguuagcucuucacuuauuguuuugguuacuuguaaauucugaucuac

SEQ ID NO: 1603 - RNA, 352 nt, artificial sequence
  synthetic construct
guauuaaaaucauauacugggugaaauaaacgacuuguuuccuguccucaaaauauuuguucuuaaauucaauaauagcaucccugaaagcaucugcgaauauuauaacuugucuaaugcuuaaauucaagcauuuaaauguuagcucuucacuuauuguuuugguuacuuguaaauucugaucuaucauuugaaaaauaauaauuggggcuggcguacgagaauaugacucugaauaagguucaguauucauccuccauuccucuuuuucugauuuaagaguauuuugcauccauucacuauaguucgcuucaauauucuuaagauagucuucuucuaaucugucuauaac

SEQ ID NO: 1604 - RNA, 351 nt, artificial sequence
  synthetic construct
guuuucuacacuuucugggacuguaaaaauauguuucagauuuucuuuggcuguuacauauugcgaaugccucauauuuucaucucuaauaucacagaguaccuuacuaagcucugguacaucagaaaauaagucugacaucuuuuucauacuaauauuaauuucagauacuucuucgagacaccuguguaguugauucaaaccaauucuaacaccaucuagcuguugcugcauugcugacuucagcaaugcuucaacugaagcuuuuuuucgaacauaucguuguuuuauuuggucaauuuuuucuaauuguccuggccuauucaauguauuuaucacuuuaguaguagc

SEQ ID NO: 1605 - RNA, 351 nt, artificial sequence
  synthetic construct
guuucugauuuaagaguauuuugcauccauucacuauaguucgcuucaauauucuuaagauagucuucuucuaaucugucuauaacagcagauggaaguaaaggagguaaauuuucaguagaggucacuaaaucagggugaccuaacaugucuuuggcucgauaaguuuuaagaacccaagacagcauuguaacauauucauuaccuugaaggccauuuuguauaauuuccugcagauguacggaaaggcauccaugguagauaugaauauauuuaucuaauauuuuauaacuuggaggaaagcacgguaagcaaagaguuuugacaauucuuaaaucuucuaaaaucauc

SEQ ID NO: 1606 - RNA, 351 nt, artificial sequence
  synthetic construct
guagaaaguuaaauuaauauuuacaagcuuaggaaacaccagggucuuaaacacugugcucuuaugcagaacuuuaggcuuaucuacaugcacaacuuuaucucugacaucugaucuugacaggucuccucucagguucagcagucuuaaaagaugaucaucaguaauaucaggauacuuuucaaccacccuauguagcucaaaggauaacaugucaucaucgcuuuucagcacuucagagagcauaaugauggcaucaaauggguucucgcauucuauaucauuacugagauuuucaaagaguuuguugaaucuauuggcuucuuccgaaacuuuuugggcagcuuucac

SEQ ID NO: 1607 - RNA, 352 nt, artificial sequence
  synthetic construct
gucuuaaauucaauaauagcaucccugaaagcaucugcgaauauuauaacuugucuaaugcuuaaauucaagcauuuaaauguuagcucuucacuuauuguuuugguuacuuguaaauucugaucuaucauuugaaaaauaauaauuggggcuggcguacgagaauaugacucugaauaagguucaguauucauccuccauuccucuuuuucugauuuaagaguauuuugcauccauucacuauaguucgcuucaauauucuuaagauagucuucuucuaaucugucuauaacagcagauggaaguaaaggagguaaauuuucaguagaggucacuaaaucagggugaccuc

SEQ ID NO: 1608 - RNA, 352 nt, artificial sequence
  synthetic construct
guuuaggcuuaucuacaugcacaacuuuaucucugacaucugaucuugacaggucuccucucagguucagcagucuuaaaagaugaucaucaguaauaucaggauacuuuucaaccacccuauguagcucaaaggauaacaugucaucaucgcuuuucagcacuucagagagcauaaugauggcaucaaauggguucucgcauucuauaucauuacugagauuuucaaagaguuuguugaaucuauuggcuucuuccgaaacuuuuugggcagcuuucaugcauucaucgaaaguuuugaaagauaugcgccuagacagcauagcuguaagauauuuucuacccacuagggc

SEQ ID NO: 1609 - RNA, 351 nt, artificial sequence
  synthetic construct
gacaacuuuaucucugacaucugaucuugacaggucuccucucagguucagcagucuuaaaagaugaucaucaguaauaucaggauacuuuucaaccacccuauguagcucaaaggauaacaugucaucaucgcuuuucagcacuucagagagcauaaugauggcaucaaauggguucucgcauucuauaucauuacugagauuuucaaagaguuuguugaaucuauuggcuucuuccgaaacuuuuugggcagcuuucaugcauucaucgaaaguuuugaaagauaugcgccuagacagcauagcuguaagauauuuucuacccacuaggguuaauaauaauuccacugc

SEQ ID NO: 1610 - RNA, 352 nt, artificial sequence
  synthetic construct
guaaauuaauauuuacaagcuuaggaaacaccagggucuuaaacacugugcucuuaugcagaacuuuaggcuuaucuacaugcacaacuuuaucucugacaucugaucuugacaggucuccucucagguucagcagucuuaaaagaugaucaucaguaauaucaggauacuuuucaaccacccuauguagcucaaaggauaacaugucaucaucgcuuuucagcacuucagagagcauaaugauggcaucaaauggguucucgcauucuauaucauuacugagauuuucaaagaguuuguugaaucuauuggcuucuuccgaaacuuuuugggcagcuuucaugcauucauc

SEQ ID NO: 1611 - RNA, 351 nt, artificial sequence
  synthetic construct
gcuagccguuucaggaaagacacauuuacuuacuaacuugucagcuugaucauauaaugaauaaugcaaauaguuucucaauaagcaauuuauaaguacagcuuguccuucaaaaucauuucuaagaguagcaguacgaagacgagaauguagaaaaccucuaauugaaucaaguuuaucaguaaguucagaaacccuugagugauaaaaguagcacuuagcugcuacaagaucuauggaacggcgauuuugacuaguaauuuuauucaugagugcuugagaacaacguucugcuucugguaguuuauuagugucaaucaaacgaaccaaaauuaacaaguuaauauaagc

SEQ ID NO: 1612 - RNA, 351 nt, artificial sequence
  synthetic construct
gucaacuucuggaacaggaguuuuugaagcugaucuagcucuagauugcguagugucaaguucaguugcagccucuucaguaaaaccaaguaggacgucucucucggcuacaggauauauuugguuuauaagacuucugagaacuacuccauuaagcuuucgucuaguguugggcaaacaacgcaaaacucuuaaaauaaaucgauuuuccuugcugcuuacggcuuuuucaaucugucuugcauguucucgaauuucuauuacacuuugcaugucagugucuuuuuugcuaucuccagcuuccaauccuccaggacugucggcguuuuucauuucaacaucuguuucaac

SEQ ID NO: 1613 - RNA, 351 nt, artificial sequence
  synthetic construct
guaucucauagcuuucacacuuugauuaugcaaaucuaagcaaaaugauauucucugaugaaaagcaaguugugguuccuuuguacaguaaauaucuguacucucuuuacuucucaugaaaccaccuugaggaucuagaguagccucaauuaccccaucacgaauggcuuuugccacaauaaauucugcaucuucagcugaaucaagaccaaguuuuuuagcuauaucuugaggagaaauucuagaauaagacagaccaauagaucuuauagccgucuuuaugacauugugacggagacguagaauuaaaguaaaaguauggucuugucuaaauugugguccaaaguuuuc

SEQ ID NO: 1614 - RNA, 352 nt, artificial sequence
  synthetic construct
guaaauucugcaucuucagcugaaucaagaccaaguuuuuuagcuauaucuugaggagaaauucuagaauaagacagaccaauagaucuuauagccgucuuuaugacauugugacggagacguagaauuaaaguaaaaguauggucuugucuaaauugugguccaaaguuuuccaaaacuucuccaaaucucugcaaauuucccauucuuaccgccugagucaacugaaaguaaggugcaagggaaugccucaugcuggcuugccuaaauauuugucucucugguauaucucccaauaguaauucaacuacaacaguuaguuucugaacaguuugucuaaaaccuauugcac

SEQ ID NO: 1615 - RNA, 352 nt, artificial sequence
  synthetic construct
guuugucuaaaaccuauugcagcauucugaggugcuuuucucauggcuugaacaaggugcuuaugggcuacacuguauucuaaucuagcagcuuuaauucgacccaaauaauacaaaaaucuggcccauucauuauuacuagccguuucaggaaagacacauuuacuuacuaacuugucagcuugaucauauaaugaauaaugcaaauaguuucucaauaagcaauuuauaaguacagcuuguccuucaaaaucauuucuaagaguagcaguacgaagacgagaauguagaaaaccucuaauugaaucaaguuuaucaguaaguucagaaacccuugagugauaaaaguagc

SEQ ID NO: 1616 - RNA, 352 nt, artificial sequence
  synthetic construct
guucagcagauucuaacuccuuuccauaggcuuuuggaggauaucucauagcuuucacacuuugauuaugcaaaucuaagcaaaaugauauucucugaugaaaagcaaguugugguuccuuuguacaguaaauaucuguacucucuuuacuucucaugaaaccaccuugaggaucuagaguagccucaauuaccccaucacgaauggcuuuugccacaauaaauucugcaucuucagcugaaucaagaccaaguuuuuuagcuauaucuugaggagaaauucuagaauaagacagaccaauagaucuuauagccgucuuuaugacauugugacggagacguagaauuaaagc

SEQ ID NO: 1617 - RNA, 352 nt, artificial sequence
  synthetic construct
gaucaucaucuucuucugccauuucuuuugcuaauucuaaaucuuguuguucccuuucccuucuuucuucagcagauucuaacuccuuuccauaggcuuuuggaggauaucucauagcuuucacacuuugauuaugcaaaucuaagcaaaaugauauucucugaugaaaagcaaguugugguuccuuuguacaguaaauaucuguacucucuuuacuucucaugaaaccaccuugaggaucuagaguagccucaauuaccccaucacgaauggcuuuugccacaauaaauucugcaucuucagcugaaucaagaccaaguuuuuuagcuauaucuugaggagaaauucuagc

SEQ ID NO: 1618 - RNA, 351 nt, artificial sequence
  synthetic construct
guuucacacuuugauuaugcaaaucuaagcaaaaugauauucucugaugaaaagcaaguugugguuccuuuguacaguaaauaucuguacucucuuuacuucucaugaaaccaccuugaggaucuagaguagccucaauuaccccaucacgaauggcuuuugccacaauaaauucugcaucuucagcugaaucaagaccaaguuuuuuagcuauaucuugaggagaaauucuagaauaagacagaccaauagaucuuauagccgucuuuaugacauugugacggagacguagaauuaaaguaaaaguauggucuugucuaaauugugguccaaaguuuuccaaaacuucuc

SEQ ID NO: 1619 - RNA, 352 nt, artificial sequence
  synthetic construct
guacuuacuaacuugucagcuugaucauauaaugaauaaugcaaauaguuucucaauaagcaauuuauaaguacagcuuguccuucaaaaucauuucuaagaguagcaguacgaagacgagaauguagaaaaccucuaauugaaucaaguuuaucaguaaguucagaaacccuugagugauaaaaguagcacuuagcugcuacaagaucuauggaacggcgauuuugacuaguaauuuuauucaugagugcuugagaacaacguucugcuucugguaguuuauuagugucaaucaaacgaaccaaaauuaacaaguuaauauaagcaucaacuucuggaacaggaguuuuuc

SEQ ID NO: 1620 - RNA, 351 nt, artificial sequence
  synthetic construct
gauacaaaaaucuggcccauucauuauuacuagccguuucaggaaagacacauuuacuuacuaacuugucagcuugaucauauaaugaauaaugcaaauaguuucucaauaagcaauuuauaaguacagcuuguccuucaaaaucauuucuaagaguagcaguacgaagacgagaauguagaaaaccucuaauugaaucaaguuuaucaguaaguucagaaacccuugagugauaaaaguagcacuuagcugcuacaagaucuauggaacggcgauuuugacuaguaauuuuauucaugagugcuugagaacaacguucugcuucugguaguuuauuagugucaaucaaac

SEQ ID NO: 1621 - RNA, 352 nt, artificial sequence
  synthetic construct
guucuaaaucuuguuguucccuuucccuucuuucuucagcagauucuaacuccuuuccauaggcuuuuggaggauaucucauagcuuucacacuuugauuaugcaaaucuaagcaaaaugauauucucugaugaaaagcaaguugugguuccuuuguacaguaaauaucuguacucucuuuacuucucaugaaaccaccuugaggaucuagaguagccucaauuaccccaucacgaauggcuuuugccacaauaaauucugcaucuucagcugaaucaagaccaaguuuuuuagcuauaucuugaggagaaauucuagaauaagacagaccaauagaucuuauagccgucuc

SEQ ID NO: 1622 - RNA, 352 nt, artificial sequence
  synthetic construct
guaucuaaguaaucuucugccaaaauugggggaccuuuaucaauugguuuuccagauccguugaacacucuacccaacauauccucagauacuggaguucugagaauaucaccagugaauucacauacuguguuuuuggcaucaauuccugaggugccuucaaauacuuguacuacagcuuuauucccacugacuuccaaaacuugaccagaucuuaaaguuccaucagccaaucuaaguuggacaauuucguugaauuuugggaacuuuacaucuuccagaauuaccaguggaccauugacaccagauaccguuuuauaagugagucugggcugagauacaaaaucucugc

SEQ ID NO: 1623 - RNA, 351 nt, artificial sequence
  synthetic construct
gauaucaccagugaauucacauacuguguuuuuggcaucaauuccugaggugccuucaaauacuuguacuacagcuuuauucccacugacuuccaaaacuugaccagaucuuaaaguuccaucagccaaucuaaguuggacaauuucguugaauuuugggaacuuuacaucuuccagaauuaccaguggaccauugacaccagauaccguuuuauaagugagucugggcugagauacaaaaucucuggaaacagccaaaauauguucccgugaggccuguuuugcauuuaacgucgaaggguaagacaucuucucugaaggaaagauacgucugucacaaaccacaaaaac

SEQ ID NO: 1624 - RNA, 352 nt, artificial sequence
  synthetic construct
guuucuucaggauaaauacgugaccauggguugauagguugaccuuggauaucuaaguaaucuucugccaaaauugggggaccuuuaucaauugguuuuccagauccguugaacacucuacccaacauauccucagauacuggaguucugagaauaucaccagugaauucacauacuguguuuuuggcaucaauuccugaggugccuucaaauacuuguacuacagcuuuauucccacugacuuccaaaacuugaccagaucuuaaaguuccaucagccaaucuaaguuggacaauuucguugaauuuugggaacuuuacaucuuccagaauuaccaguggaccauugacac

SEQ ID NO: 1625 - RNA, 352 nt, artificial sequence
  synthetic construct
guagcagcaaacacaauagcaaaguuaucuucauggucauccaauacagauuugccgggaauuuugacaagaccggcuugucgacaaauuugagcagcaauuucguugugaggcagaccagcggccgagaaaaugggaauuuuuuggccacgggcaauggaguucauuacgucgauggcggagauaccaguuuggaucauuucuucaggauaaauacgugaccauggguugauagguugaccuuggauaucuaaguaaucuucugccaaaauugggggaccuuuaucaauugguuuuccagauccguugaacacucuacccaacauauccucagauacuggaguucugagac

SEQ ID NO: 1626 - RNA, 351 nt, artificial sequence
  synthetic construct
guaaugacgcgagucucugggauagaauucggccaauauacuggcugggauacguuucaacauuuccuuggggaagauacggaguaguugccaaccgauguccaaugauucgaaaacgguacgguuuucguaguuacccugagugaugaaguucuuuucgaauuucguuaagaauuccaaguacaggagaucgucagguguaagagcuuccucuccuacuacggcuuucauagcuuggacauccuuaccgauagcguaacaggcauacaguugguuagaaacgucagagugaucuuuccuggucauacccucaccaauggcggauuucaucaaacgagacaaagagggcac

SEQ ID NO: 1627 - RNA, 352 nt, artificial sequence
  synthetic construct
gaucuaaguaaucuucugccaaaauugggggaccuuuaucaauugguuuuccagauccguugaacacucuacccaacauauccucagauacuggaguucugagaauaucaccagugaauucacauacuguguuuuuggcaucaauuccugaggugccuucaaauacuuguacuacagcuuuauucccacugacuuccaaaacuugaccagaucuuaaaguuccaucagccaaucuaaguuggacaauuucguugaauuuugggaacuuuacaucuuccagaauuaccaguggaccauugacaccagauaccguuuuauaagugagucugggcugagauacaaaaucucuggc

SEQ ID NO: 1628 - RNA, 352 nt, artificial sequence
  synthetic construct
gaaacagacauacauuuuccauggaaccauuuucuucgaaaucuuguuugaaaaaccuagcaguuuccauguuaacucccauagcagcaaacacaauagcaaaguuaucuucauggucauccaauacagauuugccgggaauuuugacaagaccggcuugucgacaaauuugagcagcaauuucguugugaggcagaccagcggccgagaaaaugggaauuuuuuggccacgggcaauggaguucauuacgucgauggcggagauaccaguuuggaucauuucuucaggauaaauacgugaccauggguugauagguugaccuuggauaucuaaguaaucuucugccaaaac

SEQ ID NO: 1629 - RNA, 352 nt, artificial sequence
  synthetic construct
gugccaaccgauguccaaugauucgaaaacgguacgguuuucguaguuacccugagugaugaaguucuuuucgaauuucguuaagaauuccaaguacaggagaucgucagguguaagagcuuccucuccuacuacggcuuucauagcuuggacauccuuaccgauagcguaacaggcauacaguugguuagaaacgucagagugaucuuuccuggucauacccucaccaauggcggauuucaucaaacgagacaaagagggcaauacauugacuggaggauagauuugccuauugugcaauugacggucuacguagaucugucccucgguaauauaaccugucaaaucgggc

SEQ ID NO: 1630 - RNA, 352 nt, artificial sequence
  synthetic construct
gcaacauauccucagauacuggaguucugagaauaucaccagugaauucacauacuguguuuuuggcaucaauuccugaggugccuucaaauacuuguacuacagcuuuauucccacugacuuccaaaacuugaccagaucuuaaaguuccaucagccaaucuaaguuggacaauuucguugaauuuugggaacuuuacaucuuccagaauuaccaguggaccauugacaccagauaccguuuuauaagugagucugggcugagauacaaaaucucuggaaacagccaaaauauguucccgugaggccuguuuugcauuuaacgucgaaggguaagacaucuucucugaagc

SEQ ID NO: 1631 - RNA, 351 nt, artificial sequence
  synthetic construct
gaaauaggcuccagaaggaucacacuggaauaaauaaggccuauuauugucccauccacagaucaauaaagaaacaccaaaaggucugacaccuccagauuggguauacucuugcauuacugcugcuacucucugaaccaauugcacuguaggaauagguuccugauacacaagguaauauuguugggccauuuuacgcgcuuguuuuacuagcaaacgguaaucuggucccaugccagaauaaaccauuccaauguguuugguaaucauuucaacuuugugaacgcuguguucaucauaaagaauugauuuauguuuguuuucuguagcuauuacaacuccauuacaugc

SEQ ID NO: 1632 - RNA, 351 nt, artificial sequence
  synthetic construct
guuugccaaaaaguccuucacuguagaaggaucgaaccuucugaaaccugauucaucgcaaauuccaacuucaauguuaucagcugucaucuggcccucgaaacuuucuuuuaauguuaaaauugcaguguguacagcaucgucuaauuccaauucuucacuguaccuuuuuuccaagaaaguuuucccauuaacauaauuuuugcccauagcaguagcuuuccaagcaaaauaggcuccagaaggaucacacuggaauaaauaaggccuauuauugucccauccacagaucaauaaagaaacaccaaaaggucugacaccuccagauuggguauacucuugcauuacugc

SEQ ID NO: 1633 - RNA, 352 nt, artificial sequence
  synthetic construct
guccuucacuguagaaggaucgaaccuucugaaaccugauucaucgcaaauuccaacuucaauguuaucagcugucaucuggcccucgaaacuuucuuuuaauguuaaaauugcaguguguacagcaucgucuaauuccaauucuucacuguaccuuuuuuccaagaaaguuuucccauuaacauaauuuuugcccauagcaguagcuuuccaagcaaaauaggcuccagaaggaucacacuggaauaaauaaggccuauuauugucccauccacagaucaauaaagaaacaccaaaaggucugacaccuccagauuggguauacucuugcauuacugcugcuacucucugc

SEQ ID NO: 1634 - RNA, 352 nt, artificial sequence
  synthetic construct
gcucugaaccaauugcacuguaggaauagguuccugauacacaagguaauauuguugggccauuuuacgcgcuuguuuuacuagcaaacgguaaucuggucccaugccagaauaaaccauuccaauguguuugguaaucauuucaacuuugugaacgcuguguucaucauaaagaauugauuuauguuuguuuucuguagcuauuacaacuccauuacaugcuuuaauuccuacugauggugcgccugccgcuacagccgcuaaggcauauucaauuugaacuaauuuaccggaagggcuaaaaguaguuaaagaaaaacuauaacguucggaugccauuauuucuaaugac

SEQ ID NO: 1635 - RNA, 350 nt, artificial sequence
  synthetic construct
gcuuuccaagcaaaauaggcuccagaaggaucacacuggaauaaauaaggccuauuauugucccauccacagaucaauaaagaaacaccaaaaggucugacaccuccagauuggguauacucuugcauuacugcugcuacucucugaaccaauugcacuguaggaauagguuccugauacacaagguaauauuguugggccauuuuacgcgcuuguuuuacuagcaaacgguaaucuggucccaugccagaauaaaccauuccaauguguuugguaaucauuucaacuuugugaacgcuguguucaucauaaagaauugauuuauguuuguuuucuguagcuauuacaac

SEQ ID NO: 1636 - RNA, 351 nt, artificial sequence
  synthetic construct
gcacuggaauaaauaaggccuauuauugucccauccacagaucaauaaagaaacaccaaaaggucugacaccuccagauuggguauacucuugcauuacugcugcuacucucugaaccaauugcacuguaggaauagguuccugauacacaagguaauauuguugggccauuuuacgcgcuuguuuuacuagcaaacgguaaucuggucccaugccagaauaaaccauuccaauguguuugguaaucauuucaacuuugugaacgcuguguucaucauaaagaauugauuuauguuuguuuucuguagcuauuacaacuccauuacaugcuuuaauuccuacugauggugc

SEQ ID NO: 1637 - RNA, 352 nt, artificial sequence
  synthetic construct
guucugaaaccugauucaucgcaaauuccaacuucaauguuaucagcugucaucuggcccucgaaacuuucuuuuaauguuaaaauugcaguguguacagcaucgucuaauuccaauucuucacuguaccuuuuuuccaagaaaguuuucccauuaacauaauuuuugcccauagcaguagcuuuccaagcaaaauaggcuccagaaggaucacacuggaauaaauaaggccuauuauugucccauccacagaucaauaaagaaacaccaaaaggucugacaccuccagauuggguauacucuugcauuacugcugcuacucucugaaccaauugcacuguaggaauagguc

SEQ ID NO: 1638 - RNA, 352 nt, artificial sequence
  synthetic construct
gcuuuccaagcaaaauaggcuccagaaggaucacacuggaauaaauaaggccuauuauugucccauccacagaucaauaaagaaacaccaaaaggucugacaccuccagauuggguauacucuugcauuacugcugcuacucucugaaccaauugcacuguaggaauagguuccugauacacaagguaauauuguugggccauuuuacgcgcuuguuuuacuagcaaacgguaaucuggucccaugccagaauaaaccauuccaauguguuugguaaucauuucaacuuugugaacgcuguguucaucauaaagaauugauuuauguuuguuuucuguagcuauuacaacuc

SEQ ID NO: 1639 - RNA, 351 nt, artificial sequence
  synthetic construct
gauagcaguagcuuuccaagcaaaauaggcuccagaaggaucacacuggaauaaauaaggccuauuauugucccauccacagaucaauaaagaaacaccaaaaggucugacaccuccagauuggguauacucuugcauuacugcugcuacucucugaaccaauugcacuguaggaauagguuccugauacacaagguaauauuguugggccauuuuacgcgcuuguuuuacuagcaaacgguaaucuggucccaugccagaauaaaccauuccaauguguuugguaaucauuucaacuuugugaacgcuguguucaucauaaagaauugauuuauguuuguuuucuguagc

SEQ ID NO: 1640 - RNA, 352 nt, artificial sequence
  synthetic construct
gccuucacuguagaaggaucgaaccuucugaaaccugauucaucgcaaauuccaacuucaauguuaucagcugucaucuggcccucgaaacuuucuuuuaauguuaaaauugcaguguguacagcaucgucuaauuccaauucuucacuguaccuuuuuuccaagaaaguuuucccauuaacauaauuuuugcccauagcaguagcuuuccaagcaaaauaggcuccagaaggaucacacuggaauaaauaaggccuauuauugucccauccacagaucaauaaagaaacaccaaaaggucugacaccuccagauuggguauacucuugcauuacugcugcuacucucugac

SEQ ID NO: 1641 - RNA, 351 nt, artificial sequence
  synthetic construct
guaucagcugucaucuggcccucgaaacuuucuuuuaauguuaaaauugcaguguguacagcaucgucuaauuccaauucuucacuguaccuuuuuuccaagaaaguuuucccauuaacauaauuuuugcccauagcaguagcuuuccaagcaaaauaggcuccagaaggaucacacuggaauaaauaaggccuauuauugucccauccacagaucaauaaagaaacaccaaaaggucugacaccuccagauuggguauacucuugcauuacugcugcuacucucugaaccaauugcacuguaggaauagguuccugauacacaagguaauauuguugggccauuuuacgc

SEQ ID NO: 1642 - RNA, 352 nt, artificial sequence
  synthetic construct
gucucuucacuaauaauagcugcuaguucguccucuacagcagccucaucuucaucagucaacuggccacuaagcaguucauugauuucauuuuguuugucuacucccucucuuguuucgucuaauauacguucaauaucuucaauauuuagagcagcauugacuuuuuucagagcuucauuuccuguuuuaagaccuucuacuaccuguacuucaacuugggcaaauucuauaucacuagccauacuuucuaaguugcuuaguugaccaucuaguuuggacagaaucuguucuugguaucguuucuuuuugaggagcaguuuugcucuuucuuuuuggccauuguuuaauc

SEQ ID NO: 1643 - RNA, 351 nt, artificial sequence
  synthetic construct
guuuuucagagcuucauuuccuguuuuaagaccuucuacuaccuguacuucaacuugggcaaauucuauaucacuagccauacuuucuaaguugcuuaguugaccaucuaguuuggacagaaucuguucuugguaucguuucuuuuugaggagcaguuuugcucuuucuuuuuggccauuguuuaauaguuucuuagcuaauuccuugucuuuaacaagagauaguucuauucuucuuugauacuguuuuaguuugucucuuugcuguuuuaguuguaauauugcuuugucuuguucaguaacucuacugggcuuuuucuuuuugccgaauauuauacccaugucgagauc

SEQ ID NO: 1644 - RNA, 352 nt, artificial sequence
  synthetic construct
guaucuucaauauuuagagcagcauugacuuuuuucagagcuucauuuccuguuuuaagaccuucuacuaccuguacuucaacuugggcaaauucuauaucacuagccauacuuucuaaguugcuuaguugaccaucuaguuuggacagaaucuguucuugguaucguuucuuuuugaggagcaguuuugcucuuucuuuuuggccauuguuuaauaguuucuuagcuaauuccuugucuuuaacaagagauaguucuauucuucuuugauacuguuuuaguuugucucuuugcuguuuuaguuguaauauugcuuugucuuguucaguaacucuacugggcuuuuucuuuc

SEQ ID NO: 1645 - RNA, 351 nt, artificial sequence
  synthetic construct
gcauugauuucauuuuguuugucuacucccucucuuguuucgucuaauauacguucaauaucuucaauauuuagagcagcauugacuuuuuucagagcuucauuuccuguuuuaagaccuucuacuaccuguacuucaacuugggcaaauucuauaucacuagccauacuuucuaaguugcuuaguugaccaucuaguuuggacagaaucuguucuugguaucguuucuuuuugaggagcaguuuugcucuuucuuuuuggccauuguuuaauaguuucuuagcuaauuccuugucuuuaacaagagauaguucuauucuucuuugauacuguuuuaguuugucucuuugc

SEQ ID NO: 1646 - RNA, 351 nt, artificial sequence
  synthetic construct
gucaacuggccacuaagcaguucauugauuucauuuuguuugucuacucccucucuuguuucgucuaauauacguucaauaucuucaauauuuagagcagcauugacuuuuuucagagcuucauuuccuguuuuaagaccuucuacuaccuguacuucaacuugggcaaauucuauaucacuagccauacuuucuaaguugcuuaguugaccaucuaguuuggacagaaucuguucuugguaucguuucuuuuugaggagcaguuuugcucuuucuuuuuggccauuguuuaauaguuucuuagcuaauuccuugucuuuaacaagagauaguucuauucuucuuugauac

SEQ ID NO: 1647 - RNA, 351 nt, artificial sequence
  synthetic construct
guaauauacguucaauaucuucaauauuuagagcagcauugacuuuuuucagagcuucauuuccuguuuuaagaccuucuacuaccuguacuucaacuugggcaaauucuauaucacuagccauacuuucuaaguugcuuaguugaccaucuaguuuggacagaaucuguucuugguaucguuucuuuuugaggagcaguuuugcucuuucuuuuuggccauuguuuaauaguuucuuagcuaauuccuugucuuuaacaagagauaguucuauucuucuuugauacuguuuuaguuugucucuuugcuguuuuaguuguaauauugcuuugucuuguucaguaacucuac

SEQ ID NO: 1648 - RNA, 350 nt, artificial sequence
  synthetic construct
gucuaauauacguucaauaucuucaauauuuagagcagcauugacuuuuuucagagcuucauuuccuguuuuaagaccuucuacuaccuguacuucaacuugggcaaauucuauaucacuagccauacuuucuaaguugcuuaguugaccaucuaguuuggacagaaucuguucuugguaucguuucuuuuugaggagcaguuuugcucuuucuuuuuggccauuguuuaauaguuucuuagcuaauuccuugucuuuaacaagagauaguucuauucuucuuugauacuguuuuaguuugucucuuugcuguuuuaguuguaauauugcuuugucuuguucaguaacuc

SEQ ID NO: 1649 - RNA, 352 nt, artificial sequence
  synthetic construct
guuguuucgucuaauauacguucaauaucuucaauauuuagagcagcauugacuuuuuucagagcuucauuuccuguuuuaagaccuucuacuaccuguacuucaacuugggcaaauucuauaucacuagccauacuuucuaaguugcuuaguugaccaucuaguuuggacagaaucuguucuugguaucguuucuuuuugaggagcaguuuugcucuuucuuuuuggccauuguuuaauaguuucuuagcuaauuccuugucuuuaacaagagauaguucuauucuucuuugauacuguuuuaguuugucucuuugcuguuuuaguuguaauauugcuuugucuuguucac

SEQ ID NO: 1650 - RNA, 351 nt, artificial sequence
  synthetic construct
guauuucuuagcggcugcugcuucaucuucccucugguaguucugcaacacuucuugcuucuuuguagcaauacguucuucccgucuuucucuagcuuguuucaccuucauucuccuggcauuagcuugaucugcuaacaucuuagcacgugccuucucagccuucuuuuugugaauguauuccauaagaacacguuuguucuugaauacauuacccuuagccuucauguacagugagugguauagaugucugucaaucuuuuucgcuucccgauauuuuuuuaauaaucgacgcaaaacgcgcaugcgcuggauccauaauuccuuuugggguguacgggcauuagcagc

SEQ ID NO: 1651 - RNA, 351 nt, artificial sequence
  synthetic construct
gauacauuacccuuagccuucauguacagugagugguauagaugucugucaaucuuuuucgcuucccgauauuuuuuuaauaaucgacgcaaaacgcgcaugcgcuggauccauaauuccuuuugggguguacgggcauuagcaguaccuuuccuuuuaccaaaaccgcagugccuccccuuucuacgagcuucgguguucuuacguacgcgggcacgugaauguaccgcuacagguuucuuaauaauaagaccauccuugaucaauuuacgaauauuuugucuggaauuuguauuggcaaucucauugauuucauuaggauccaaccauacuuucuucuuaccacaucuc

SEQ ID NO: 1652 - RNA, 351 nt, artificial sequence
  synthetic construct
gucaaucuuuuucgcuucccgauauuuuuuuaauaaucgacgcaaaacgcgcaugcgcuggauccauaauuccuuuugggguguacgggcauuagcaguaccuuuccuuuuaccaaaaccgcagugccuccccuuucuacgagcuucgguguucuuacguacgcgggcacgugaauguaccgcuacagguuucuuaauaauaagaccauccuugaucaauuuacgaauauuuugucuggaauuuguauuggcaaucucauugauuucauuaggauccaaccauacuuucuucuuaccacaucucauaacagaggcugccagccucuuuugaaguuuuaaggaacucauugc

SEQ ID NO: 1653 - RNA, 351 nt, artificial sequence
  synthetic construct
guuacccuuagccuucauguacagugagugguauagaugucugucaaucuuuuucgcuucccgauauuuuuuuaauaaucgacgcaaaacgcgcaugcgcuggauccauaauuccuuuugggguguacgggcauuagcaguaccuuuccuuuuaccaaaaccgcagugccuccccuuucuacgagcuucgguguucuuacguacgcgggcacgugaauguaccgcuacagguuucuuaauaauaagaccauccuugaucaauuuacgaauauuuugucuggaauuuguauuggcaaucucauugauuucauuaggauccaaccauacuuucuucuuaccacaucucauaac

SEQ ID NO: 1654 - RNA, 351 nt, artificial sequence
  synthetic construct
gacuaaugggucaaccuuauuggguaaaaucuuaugcaauguguaugauucauuucuaagggcuacucuacaauuuggugugacaucauuaaugucaauguuuuuaucgauaucaacaacaaauuuuccuucaggguguacuuugacaaguacuuuuuucuuguccauggguuuuacaacuucaccaacauagcuucccuguucuugaagaagcaucaguucuucucuaagcauacgaacuuuagcauuaaguucauuccuuugagcuuguaaccuacgaagauuuugacuuuuuucagcuacaauaagcuguaacucuucaauuuuggugauauaauaugaucuaaaucc

SEQ ID NO: 1655 - RNA, 352 nt, artificial sequence
  synthetic construct
guucaaaaucuucuugugucacaugaacccuucucucccucaaagcguacauacccgccucugugcaaacacccuuaacuucagccccgcuagcaccuggcauuaauucagcgauuuuccuuaaauugauaccucuaguuagauucauuuuucucgaaugaauuuucaaaauguccaaucuggcuucuucguucgguggagggaacucaauuuuucugucaauucuuccaggucuaagcaaagcaggaucaagaaugucuauucuguugguagccaugaugacuuuaauguuuuugguugcuucaaaaccaucaagcugauuuaacaacuccaacaugguucuuuggacuuc

SEQ ID NO: 1656 - RNA, 351 nt, artificial sequence
  synthetic construct
gagcauuaaguucauuccuuugagcuuguaaccuacgaagauuuugacuuuuuucagcuacaauaagcuguaacucuucaauuuuggugauauaauaugaucuaaauccuucaccuuugagggccccauccaccuccauucucugugguguuucuacacuuguagccaugucuaccgguauuucagauugugguuuguuuucuaaauuuuuugaacugucuucuauagaagauuuuuucuuuuuguuucuuuuaaauuuugcaagggacccacuuugucccauuuuaccaaaauuuuugaaaaauauuaaugaaauaaugacauuuugaaaauaacaaaagacaaacugac

SEQ ID NO: 1657 - RNA, 351 nt, artificial sequence
  synthetic construct
gcugugcaaacacccuuaacuucagccccgcuagcaccuggcauuaauucagcgauuuuccuuaaauugauaccucuaguuagauucauuuuucucgaaugaauuuucaaaauguccaaucuggcuucuucguucgguggagggaacucaauuuuucugucaauucuuccaggucuaagcaaagcaggaucaagaaugucuauucuguugguagccaugaugacuuuaauguuuuugguugcuucaaaaccaucaagcugauuuaacaacuccaacaugguucuuuggacuucagaaucaccaccagagccagauucaauacgagaagauccuauagaaucaauuucgucc

SEQ ID NO: 1658 - RNA, 351 nt, artificial sequence
  synthetic construct
guuuuucugucaauucuuccaggucuaagcaaagcaggaucaagaaugucuauucuguugguagccaugaugacuuuaauguuuuugguugcuucaaaaccaucaagcugauuuaacaacuccaacaugguucuuuggacuucagaaucaccaccagagccagauucaauacgagaagauccuauagaaucaauuucguccaugaaaaugauggaaggugcaugcucucuggccauaacgaagagcucccugaccauucuggagcccucuccaaugaauuuuugaaccaauucugaaccagauacucgaaugaauguacauucuguaugaugagcuacugcucuggccaac

SEQ ID NO: 1659 - RNA, 351 nt, artificial sequence
  synthetic construct
gcguauguagaaucagguacuuuuucuaccaucauaagugauacuaaugggucaaccuuauuggguaaaaucuuaugcaauguguaugauucauuucuaagggcuacucuacaauuuggugugacaucauuaaugucaauguuuuuaucgauaucaacaacaaauuuuccuucaggguguacuuugacaaguacuuuuuucuuguccauggguuuuacaacuucaccaacauagcuucccuguucuugaagaagcaucaguucuucucuaagcauacgaacuuuagcauuaaguucauuccuuugagcuuguaaccuacgaagauuuugacuuuuuucagcuacaauaagc

SEQ ID NO: 1660 - RNA, 352 nt, artificial sequence
  synthetic construct
guuuaucuaaaccuccaaccauuucguauguagaaucagguacuuuuucuaccaucauaagugauacuaaugggucaaccuuauuggguaaaaucuuaugcaauguguaugauucauuucuaagggcuacucuacaauuuggugugacaucauuaaugucaauguuuuuaucgauaucaacaacaaauuuuccuucaggguguacuuugacaaguacuuuuuucuuguccauggguuuuacaacuucaccaacauagcuucccuguucuugaagaagcaucaguucuucucuaagcauacgaacuuuagcauuaaguucauuccuuugagcuuguaaccuacgaagauuuuc

SEQ ID NO: 1661 - RNA, 351 nt, artificial sequence
  synthetic construct
guucaaaauguccaaucuggcuucuucguucgguggagggaacucaauuuuucugucaauucuuccaggucuaagcaaagcaggaucaagaaugucuauucuguugguagccaugaugacuuuaauguuuuugguugcuucaaaaccaucaagcugauuuaacaacuccaacaugguucuuuggacuucagaaucaccaccagagccagauucaauacgagaagauccuauagaaucaauuucguccaugaaaaugauggaaggugcaugcucucuggccauaacgaagagcucccugaccauucuggagcccucuccaaugaauuuuugaaccaauucugaaccagauac

SEQ ID NO: 1662 - RNA, 351 nt, artificial sequence
  synthetic construct
gucuugugucacaugaacccuucucucccucaaagcguacauacccgccucugugcaaacacccuuaacuucagccccgcuagcaccuggcauuaauucagcgauuuuccuuaaauugauaccucuaguuagauucauuuuucucgaaugaauuuucaaaauguccaaucuggcuucuucguucgguggagggaacucaauuuuucugucaauucuuccaggucuaagcaaagcaggaucaagaaugucuauucuguugguagccaugaugacuuuaauguuuuugguugcuucaaaaccaucaagcugauuuaacaacuccaacaugguucuuuggacuucagaaucacc

SEQ ID NO: 1663 - RNA, 352 nt, artificial sequence
  synthetic construct
guuuguuuaucuaaaccuccaaccauuucguauguagaaucagguacuuuuucuaccaucauaagugauacuaaugggucaaccuuauuggguaaaaucuuaugcaauguguaugauucauuucuaagggcuacucuacaauuuggugugacaucauuaaugucaauguuuuuaucgauaucaacaacaaauuuuccuucaggguguacuuugacaaguacuuuuuucuuguccauggguuuuacaacuucaccaacauagcuucccuguucuugaagaagcaucaguucuucucuaagcauacgaacuuuagcauuaaguucauuccuuugagcuuguaaccuacgaagac

SEQ ID NO: 1664 - RNA, 351 nt, artificial sequence
  synthetic construct
guuuacuggcagcucaauaaccucuuugauuucuuuaauuuguuuaucuaaaccuccaaccauuucguauguagaaucagguacuuuuucuaccaucauaagugauacuaaugggucaaccuuauuggguaaaaucuuaugcaauguguaugauucauuucuaagggcuacucuacaauuuggugugacaucauuaaugucaauguuuuuaucgauaucaacaacaaauuuuccuucaggguguacuuugacaaguacuuuuuucuuguccauggguuuuacaacuucaccaacauagcuucccuguucuugaagaagcaucaguucuucucuaagcauacgaacuuuagc

SEQ ID NO: 1665 - RNA, 352 nt, artificial sequence
  synthetic construct
guaaauucacacaaaugugccaaaccugacucuuuagcuucuggauugucuucaauaauaguuaugauaguaucagcaauagaugcuuuauauuccagaccuccuucaucucuuaacauggcugacaggaaauucauuagugugcuauguuugcgaggaaacuugagagcuagugccuugauggcuuggacaacuacaacuuugaauucaucacugauuucagaaacgaaacuugcaauuuguuucaugagacggucuacagaugauucagcaccaguuuuuaacagaguaguuauagccaaaguagcaauugaucuguuagaaucaguaaucaaguuuucuaaaucuagac

SEQ ID NO: 1666 - RNA, 350 nt, artificial sequence
  synthetic construct
gaaccugaucaguucgcucagcagcugccaacccaagaaauuguauaauauucuuuacagccucaucuaaaguguucauugaacugagagaauaaguaucuucuuuuucuacugagccuucugcugccuugucccaggccgcggcccaauugacuuugccuacccuuuggauuugauccccaagaguuacuucaaggucuucaagcauguacucuucuucguaaccaucuucacagucugguauuccagugguaggaucacaauccuugacaacaaauuuaagaacagcuccaaagguucccacacaacuuguuagaucaucaucagggaauuucaguaucacauauguc

SEQ ID NO: 1667 - RNA, 352 nt, artificial sequence
  synthetic construct
guucugaucaacauacaagcagcauauggagauuucaaagacauucuagucaaucuggcuauuaauuuuguuacagccaaccgaucugucuuucuaauaugauaaaguaguccuaaugcaugauauuguaccaucacauugucacuguuaauugcuucuugugccucauuaacccaucuuuuaacuacuucuggggccauucuagucaugugcaaggaacugacaagagcagcagaacuaacagccgaguuccuaucuacuauagcuugcuucauauaucguucuauugcuuguaacauuguagcaucagugauacugcaaagagcccuaauugcggcugcucgguagauac

SEQ ID NO: 1668 - RNA, 351 nt, artificial sequence
  synthetic construct
gcccaacaaaugcaaaauucuuacagcuaaagaaacauguucacaaucuucaauaaauucacacaaaugugccaaaccugacucuuuagcuucuggauugucuucaauaauaguuaugauaguaucagcaauagaugcuuuauauuccagaccuccuucaucucuuaacauggcugacaggaaauucauuagugugcuauguuugcgaggaaacuugagagcuagugccuugauggcuuggacaacuacaacuuugaauucaucacugauuucagaaacgaaacuugcaauuuguuucaugagacggucuacagaugauucagcaccaguuuuuaacagaguaguuauagc

SEQ ID NO: 1669 - RNA, 351 nt, artificial sequence
  synthetic construct
gauaacucgauuguagaugaaacggauguaucuugaagguugcuuugucuuuggacccucucuucccaacaaaugcaaaauucuuacagcuaaagaaacauguucacaaucuucaauaaauucacacaaaugugccaaaccugacucuuuagcuucuggauugucuucaauaauaguuaugauaguaucagcaauagaugcuuuauauuccagaccuccuucaucucuuaacauggcugacaggaaauucauuagugugcuauguuugcgaggaaacuugagagcuagugccuugauggcuuggacaacuacaacuuugaauucaucacugauuucagaaacgaaacuugc

SEQ ID NO: 1670 - RNA, 352 nt, artificial sequence
  synthetic construct
guaguaucagcaauagaugcuuuauauuccagaccuccuucaucucuuaacauggcugacaggaaauucauuagugugcuauguuugcgaggaaacuugagagcuagugccuugauggcuuggacaacuacaacuuugaauucaucacugauuucagaaacgaaacuugcaauuuguuucaugagacggucuacagaugauucagcaccaguuuuuaacagaguaguuauagccaaaguagcaauugaucuguuagaaucaguaaucaaguuuucuaaaucuagauugcaagcuguaacagcugcagggugagaaauagcuacuugauuuaauguucugacugcagcaaauc

SEQ ID NO: 1671 - RNA, 351 nt, artificial sequence
  synthetic construct
gcccaagaaauuguauaauauucuuuacagccucaucuaaaguguucauugaacugagagaauaaguaucuucuuuuucuacugagccuucugcugccuugucccaggccgcggcccaauugacuuugccuacccuuuggauuugauccccaagaguuacuucaaggucuucaagcauguacucuucuucguaaccaucuucacagucugguauuccagugguaggaucacaauccuugacaacaaauuuaagaacagcuccaaagguucccacacaacuuguuagaucaucaucagggaauuucaguaucacauaugucguccccguuugguuguaaugcaacuguucgc

SEQ ID NO: 1672 - RNA, 351 nt, artificial sequence
  synthetic construct
gucauauaucguucuauugcuuguaacauuguagcaucagugauacugcaaagagcccuaauugcggcugcucgguagauaucuucuuuuccagucauauccuugguaagacuagaagugacuauaaucacaucaucggcaguagaacucaauucuuuuauucccaaauagaccauucuucguaaaauuacgucuuucgauuggaauaauuuggucauugcaaagaaaacaucuguagcuucuuugacacugaggcuuucacccugguucaaaagauaaaguaguuuuguaagaauagggguacauuuucuuggauuuacacuuguuucauuaaaaacccgagcuucuugc

SEQ ID NO: 1673 - RNA, 352 nt, artificial sequence
  synthetic construct
guauaauauucuuuacagccucaucuaaaguguucauugaacugagagaauaaguaucuucuuuuucuacugagccuucugcugccuugucccaggccgcggcccaauugacuuugccuacccuuuggauuugauccccaagaguuacuucaaggucuucaagcauguacucuucuucguaaccaucuucacagucugguauuccagugguaggaucacaauccuugacaacaaauuuaagaacagcuccaaagguucccacacaacuuguuagaucaucaucagggaauuucaguaucacauaugucguccccguuugguuguaaugcaacuguucgcaggguauuucagc

SEQ ID NO: 1674 - RNA, 352 nt, artificial sequence
  synthetic construct
guacuucaaggucuucaagcauguacucuucuucguaaccaucuucacagucugguauuccagugguaggaucacaauccuugacaacaaauuuaagaacagcuccaaagguucccacacaacuuguuagaucaucaucagggaauuucaguaucacauaugucguccccguuugguuguaaugcaacuguucgcaggguauuucagccaaaauuucaaaguuuucauuaggguccaaaucgacccuaacauuuuccaagaguugaucagcaagaguguucaaacaaucgaauuguaaaacgauauggugagcaaaacaguguuugauacaacguacaaaauacucaguuuc

SEQ ID NO: 1675 - RNA, 351 nt, artificial sequence
  synthetic construct
guuucaaagacauucuagucaaucuggcuauuaauuuuguuacagccaaccgaucugucuuucuaauaugauaaaguaguccuaaugcaugauauuguaccaucacauugucacuguuaauugcuucuugugccucauuaacccaucuuuuaacuacuucuggggccauucuagucaugugcaaggaacugacaagagcagcagaacuaacagccgaguuccuaucuacuauagcuugcuucauauaucguucuauugcuuguaacauuguagcaucagugauacugcaaagagcccuaauugcggcugcucgguagauaucuucuuuuccagucauauccuugguaagac

SEQ ID NO: 1676 - RNA, 351 nt, artificial sequence
  synthetic construct
guacuuuuucuucucauccuucuuugcauccuuauccuuuucucccuuuuccuuaucuuuaucuuuacuauccuuauccuuacuguccuuaucuuuauccuuacuauccuucuucucuucuuucuuacccuccucagcaucuuuguuugucaguuuguuauugauuaaauuaugcaaugccacuauggaucuaaccagagcugcuaaguagacuacaagcaucugaucauuguuuuuaacauaaaaugaauuguuaaaagcaucuugguuuauaucaggcagcaaauugaaaauaucuuguaacugauagauaauuugaugauuaauagguagcguauugucacaaacauc

SEQ ID NO: 1677 - RNA, 351 nt, artificial sequence
  synthetic construct
guaucuuuaucuuuacuauccuuauccuuacuguccuuaucuuuauccuuacuauccuucuucucuucuuucuuacccuccucagcaucuuuguuugucaguuuguuauugauuaaauuaugcaaugccacuauggaucuaaccagagcugcuaaguagacuacaagcaucugaucauuguuuuuaacauaaaaugaauuguuaaaagcaucuugguuuauaucaggcagcaaauugaaaauaucuuguaacugauagauaauuugaugauuaauagguagcguauugucacaaacauuuaacaaauagucucuaaugucuuucaacugugaaugcagucccuucagaccc

SEQ ID NO: 1678 - RNA, 352 nt, artificial sequence
  synthetic construct
guucuucucauccuucuuugcauccuuauccuuuucucccuuuuccuuaucuuuaucuuuacuauccuuauccuuacuguccuuaucuuuauccuuacuauccuucuucucuucuuucuuacccuccucagcaucuuuguuugucaguuuguuauugauuaaauuaugcaaugccacuauggaucuaaccagagcugcuaaguagacuacaagcaucugaucauuguuuuuaacauaaaaugaauuguuaaaagcaucuugguuuauaucaggcagcaaauugaaaauaucuuguaacugauagauaauuugaugauuaauagguagcguauugucacaaacauuuaacaac

SEQ ID NO: 1679 - RNA, 352 nt, artificial sequence
  synthetic construct
gucauuaauagcaaugucguuuugguguaauuuggguccggugugguaccagcccacuacacguucucuagcauugacuuuuuuaaacaugccguacauauuuucuaaguaaucaugguccaaaaaccacacagauugaucuuugucauccucaucaaaaggaacugcgaaacuauucgaaacauccaagacuccuuuagcccuccaacaaccgaguaagacaccgacgacgcguuuuugguuaccgauuuuucccauacgauugaaaugauccacuacgcuaaguaagaccaauggauggacuauaacuuuaguugucguuacgucugaacuaggcauuuuaaagcccguc

SEQ ID NO: 1680 - RNA, 350 nt, artificial sequence
  synthetic construct
gcagcaaauugaaaauaucuuguaacugauagauaauuugaugauuaauagguagcguauugucacaaacauuuaacaaauagucucuaaugucuuucaacugugaaugcagucccuucagacccaacaauugauuuguaauucuuugagaaagugugccaacaguaguaucuuugauaucacguaauaaauguucuacacccacuucuucagccucuucugcuccaauuucgcuugguacguguucaaaaguuuuggauguuggugaaccaucaucauguacuuccucaacggcuugauacgcuucugugggaaggccuaagucuuuugguuuggcaucaauaauuacc

SEQ ID NO: 1681 - RNA, 351 nt, artificial sequence
  synthetic construct
gccucagcaucuuuguuugucaguuuguuauugauuaaauuaugcaaugccacuauggaucuaaccagagcugcuaaguagacuacaagcaucugaucauuguuuuuaacauaaaaugaauuguuaaaagcaucuugguuuauaucaggcagcaaauugaaaauaucuuguaacugauagauaauuugaugauuaauagguagcguauugucacaaacauuuaacaaauagucucuaaugucuuucaacugugaaugcagucccuucagacccaacaauugauuuguaauucuuugagaaagugugccaacaguaguaucuuugauaucacguaauaaauguucuacaccc

SEQ ID NO: 1682 - RNA, 352 nt, artificial sequence
  synthetic construct
gucuuugcauccuuauccuuuucucccuuuuccuuaucuuuaucuuuacuauccuuauccuuacuguccuuaucuuuauccuuacuauccuucuucucuucuuucuuacccuccucagcaucuuuguuugucaguuuguuauugauuaaauuaugcaaugccacuauggaucuaaccagagcugcuaaguagacuacaagcaucugaucauuguuuuuaacauaaaaugaauuguuaaaagcaucuugguuuauaucaggcagcaaauugaaaauaucuuguaacugauagauaauuugaugauuaauagguagcguauugucacaaacauuuaacaaauagucucuaaugc

SEQ ID NO: 1683 - RNA, 352 nt, artificial sequence
  synthetic construct
guggucuuuggugacuucgccuagacguuuacgggcuucuucuaaaacagcacggacaugaucuucucucacuuuuagaaccuucaaccuugccugguucaacauguuggaagauuggauuuucuuuuguaauucgaccugcuuuuccuucuuuucauaauauuccauaauuuugagccucuguuguugaacgagacgucccuucucgauguugaacuccuccucagccuuagcaucgauuucuucagcuuuuucauuggcuucuugcucaaugaaagccaucauauguuugaucuguuuuuggacaucugcgucacuuaaagccauuuugguugauuuguagaaacgauuc

SEQ ID NO: 1684 - RNA, 352 nt, artificial sequence
  synthetic construct
guuaaucuugaucuuguuccucaaggcaaggaguucaauuccuccggugguuucuugagauagaugggacugaucaucgauuuucaagacuaugucuuugccugugauauccuuguauuugguuuggacauuguucaagaucgauuuuaccaauucucuaucuuguggacgcacucugacggucaccucuuuuucaaagagcugguacaauccuuggagaaucaagcuuucaauaaucugaccauauuuuccuuggucuuuggugacuucgccuagacguuuacgggcuucuucuaaaacagcacggacaugaucuucucucacuuuuagaaccuucaaccuugccugguuc

SEQ ID NO: 1685 - RNA, 352 nt, artificial sequence
  synthetic construct
guucucuaucuuguggacgcacucugacggucaccucuuuuucaaagagcugguacaauccuuggagaaucaagcuuucaauaaucugaccauauuuuccuuggucuuuggugacuucgccuagacguuuacgggcuucuucuaaaacagcacggacaugaucuucucucacuuuuagaaccuucaaccuugccugguucaacauguuggaagauuggauuuucuuuuguaauucgaccugcuuuuccuucuuuucauaauauuccauaauuuugagccucuguuguugaacgagacgucccuucucgauguugaacuccuccucagccuuagcaucgauuucuucagcuuc

SEQ ID NO: 1686 - RNA, 352 nt, artificial sequence
  synthetic construct
guucaagacuaugucuuugccugugauauccuuguauuugguuuggacauuguucaagaucgauuuuaccaauucucuaucuuguggacgcacucugacggucaccucuuuuucaaagagcugguacaauccuuggagaaucaagcuuucaauaaucugaccauauuuuccuuggucuuuggugacuucgccuagacguuuacgggcuucuucuaaaacagcacggacaugaucuucucucacuuuuagaaccuucaaccuugccugguucaacauguuggaagauuggauuuucuuuuguaauucgaccugcuuuuccuucuuuucauaauauuccauaauuuugagccuc

SEQ ID NO: 1687 - RNA, 352 nt, artificial sequence
  synthetic construct
guaccaauucucuaucuuguggacgcacucugacggucaccucuuuuucaaagagcugguacaauccuuggagaaucaagcuuucaauaaucugaccauauuuuccuuggucuuuggugacuucgccuagacguuuacgggcuucuucuaaaacagcacggacaugaucuucucucacuuuuagaaccuucaaccuugccugguucaacauguuggaagauuggauuuucuuuuguaauucgaccugcuuuuccuucuuuucauaauauuccauaauuuugagccucuguuguugaacgagacgucccuucucgauguugaacuccuccucagccuuagcaucgauuucuuc

SEQ ID NO: 1688 - RNA, 352 nt, artificial sequence
  synthetic construct
guuuuaccaauucucuaucuuguggacgcacucugacggucaccucuuuuucaaagagcugguacaauccuuggagaaucaagcuuucaauaaucugaccauauuuuccuuggucuuuggugacuucgccuagacguuuacgggcuucuucuaaaacagcacggacaugaucuucucucacuuuuagaaccuucaaccuugccugguucaacauguuggaagauuggauuuucuuuuguaauucgaccugcuuuuccuucuuuucauaauauuccauaauuuugagccucuguuguugaacgagacgucccuucucgauguugaacuccuccucagccuuagcaucgauuuc

SEQ ID NO: 1689 - RNA, 351 nt, artificial sequence
  synthetic construct
guggauaguaaaaaucuagcuugagaaccgcccuguucgguaucgauguaucucggcaugggaaaucucgucugcaauauuuccugagcaucguccacgggugcuuguaacaguugucuaaaguuuucguauuccggcauaucuugguauuucaaguuacgccacugagcuauugucucuccguggaauaucaauauuuggaagaaaguguccaucaauaauauccucuccgauugaaucgaacucguauccaacagaacggguuccgggggcccguugaagcuguaacuguacaaaaucggcuggaucauaaucaaagacugcgucagaucuucucucauuaacaugugc

SEQ ID NO: 1690 - RNA, 352 nt, artificial sequence
  synthetic construct
guaaauaucaacacaaugcccauuaguugcugcucucauagccaaagcaucauaaugcuuuauaccuuuuuucauauacuuugcauuaucuuuuugaauaucaugaugagaucuaauagguuguuuuaaaucaucauucaaaaccugaccaggcccuugagagcacgguccuccaacaaaaagcauaacucuagcuccuguauugggauaagugcucuccaacaaaccaauagcuauagauaaagcaacaccgguacaucuaagagaucucuuucccugaugaacaggccagggaucuuuuugcugcucuccuauuaaaucaguuaaauucauaucgcauuuagauacaggc

SEQ ID NO: 1691 - RNA, 352 nt, artificial sequence
  synthetic construct
guaaucaaaccaauuaaagcauucggaggcaauaaacugagugacauuuguaaagaaucuuuaagugaacccaauucuuccucauccaugcaaguaucaacaacauacaagaauaucggugguaaacacugagcucuaguaauaguauacucaauaguugaaaacauaggcauuaacucagcagguugaugcuguucagaaauagcugcauauugagguggaaacggauugcguugaaaacaaaaauugcaaacccacaauuuugcucgauaaucaacuuggcacauaggauuuaaaaucgcucugcaguuauuucuuguacacagaacgggaucauacuguauggguggac

SEQ ID NO: 1692 - RNA, 350 nt, artificial sequence
  synthetic construct
gagcuauugucucuccguggaauaucaauauuuggaagaaaguguccaucaauaauauccucuccgauugaaucgaacucguauccaacagaacggguuccgggggcccguugaagcuguaacuguacaaaaucggcuggaucauaaucaaagacugcgucagaucuucucucauuaacaugugccgauaauacgacguuucguccggugaauuauugaaaacuugcaggaauugagaacgucucagaugguacaugaauuggggauagaggcuaaaguuuugacccaaucugaacgaauucgcgucguccuuguuguauucuccgaauuuuugacacaaucuaaucaac

SEQ ID NO: 1693 - RNA, 352 nt, artificial sequence
  synthetic construct
guuuacauucaaugauacgcaagaaccaaucccuccuugcacuuucaauucucuagaacauuucacuuccagagucccguugaaagccauuuuuaauucgcccuuuugaucuuuggugaacacccguuggaaugucuguuugaauagggaggaauugaaugaaucucccauuaccaugugaccgccuguagaauugcagcacuguuucaucuccaucaaaccagucugauccaaagcacaagaauaaauaucaacacaaugcccauuaguugcugcucucauagccaaagcaucauaaugcuuuauaccuuuuuucauauacuuugcauuaucuuuuugaauaucaugaugc

SEQ ID NO: 1694 - RNA, 350 nt, artificial sequence
  synthetic construct
gcacuuucaauucucuagaacauuucacuuccagagucccguugaaagccauuuuuaauucgcccuuuugaucuuuggugaacacccguuggaaugucuguuugaauagggaggaauugaaugaaucucccauuaccaugugaccgccuguagaauugcagcacuguuucaucuccaucaaaccagucugauccaaagcacaagaauaaauaucaacacaaugcccauuaguugcugcucucauagccaaagcaucauaaugcuuuauaccuuuuuucauauacuuugcauuaucuuuuugaauaucaugaugagaucuaauagguuguuuuaaaucaucauucaaaacc

SEQ ID NO: 1695 - RNA, 352 nt, artificial sequence
  synthetic construct
gauaaauaucaacacaaugcccauuaguugcugcucucauagccaaagcaucauaaugcuuuauaccuuuuuucauauacuuugcauuaucuuuuugaauaucaugaugagaucuaauagguuguuuuaaaucaucauucaaaaccugaccaggcccuugagagcacgguccuccaacaaaaagcauaacucuagcuccuguauugggauaagugcucuccaacaaaccaauagcuauagauaaagcaacaccgguacaucuaagagaucucuuucccugaugaacaggccagggaucuuuuugcugcucuccuauuaaaucaguuaaauucauaucgcauuuagauacagc

SEQ ID NO: 1696 - RNA, 352 nt, artificial sequence
  synthetic construct
guaauucaugaacuuggaccauuuuuccaaauguaaucaaaccaauuaaagcauucggaggcaauaaacugagugacauuuguaaagaaucuuuaagugaacccaauucuuccucauccaugcaaguaucaacaacauacaagaauaucggugguaaacacugagcucuaguaauaguauacucaauaguugaaaacauaggcauuaacucagcagguugaugcuguucagaaauagcugcauauugagguggaaacggauugcguugaaaacaaaaauugcaaacccacaauuuugcucgauaaucaacuuggcacauaggauuuaaaaucgcucugcaguuauuucuugc

SEQ ID NO: 1697 - RNA, 351 nt, artificial sequence
  synthetic construct
gcaaagcacaagaauaaauaucaacacaaugcccauuaguugcugcucucauagccaaagcaucauaaugcuuuauaccuuuuuucauauacuuugcauuaucuuuuugaauaucaugaugagaucuaauagguuguuuuaaaucaucauucaaaaccugaccaggcccuugagagcacgguccuccaacaaaaagcauaacucuagcuccuguauugggauaagugcucuccaacaaaccaauagcuauagauaaagcaacaccgguacaucuaagagaucucuuucccugaugaacaggccagggaucuuuuugcugcucuccuauuaaaucaguuaaauucauaucgc

SEQ ID NO: 1698 - RNA, 352 nt, artificial sequence
  synthetic construct
gaacauaggcauuaacucagcagguugaugcuguucagaaauagcugcauauugagguggaaacggauugcguugaaaacaaaaauugcaaacccacaauuuugcucgauaaucaacuuggcacauaggauuuaaaaucgcucugcaguuauuucuuguacacagaacgggaucauacuguauggguggaagaucuaaacguucuuuaaucgguugauaaagacacgcuaaugguacuaccaaacgaguugcuucuauccuacucgauggccauacauuccaaguaaaucugauuccaucucggucuucguuuuguugaauguauucuucguaaguacucauuuuuugaauc

SEQ ID NO: 1699 - RNA, 352 nt, artificial sequence
  synthetic construct
guaugguacucacucugauccuucucugaccauuagaaugcugauauugaguaauaaauuguaugcauccucuuccuccuugaggaaucggugcagaaugcugauugaccacuucgaaaaacagcgcuauagugguacuuggaguuaaagugcacauuuuccauugcaccguauuucccauaccgauuucgguauccgaaacaagcggaccuuuuacauucaaugauacgcaagaaccaaucccuccuugcacuuucaauucucuagaacauuucacuuccagagucccguugaaagccauuuuuaauucgcccuuuugaucuuuggugaacacccguuggaaugucuguuc

SEQ ID NO: 1700 - RNA, 351 nt, artificial sequence
  synthetic construct
guaguggguuuuugcugcuagccucuuaucucuuucuucagcuauggacaacuuaacucccuuuccucuuggaagagauacaaaagcuuuggcucccuuaccaauuaugaauacauuauguaaccuaguagcaaacacguggccauuagcauccuuaauguguacaauaucaaaggauccuggaugacguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaagugc

SEQ ID NO: 1701 - RNA, 350 nt, artificial sequence
  synthetic construct
guggccauuagcauccuuaauguguacaauaucaaaggauccuggaugacguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaaguguauguccaucauguguuacaaugaaugguauauuuuuugguccagucuggacucuccuaauuuugcaaaguuuguauuuagcuucuucagcuguuauacggugaauggcaaaccuuccuuuuacaucauaaauaagac

SEQ ID NO: 1702 - RNA, 352 nt, artificial sequence
  synthetic construct
guggccauuagcauccuuaauguguacaauaucaaaggauccuggaugacguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaaguguauguccaucauguguuacaaugaaugguauauuuuuugguccagucuggacucuccuaauuuugcaaaguuuguauuuagcuucuucagcuguuauacggugaauggcaaaccuuccuuuuacaucauaaauaagacgc

SEQ ID NO: 1703 - RNA, 351 nt, artificial sequence
  synthetic construct
gcguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaaguguauguccaucauguguuacaaugaaugguauauuuuuugguccagucuggacucuccuaauuuugcaaaguuuguauuuagcuucuucagcuguuauacggugaauggcaaaccuuccuuuuacaucauaaauaagacggaaaaauucuccaguuuuuucaauggugauaacauccauaaauccagc

SEQ ID NO: 1704 - RNA, 352 nt, artificial sequence
  synthetic construct
gucuuaucucuuucuucagcuauggacaacuuaacucccuuuccucuuggaagagauacaaaagcuuuggcucccuuaccaauuaugaauacauuauguaaccuaguagcaaacacguggccauuagcauccuuaauguguacaauaucaaaggauccuggaugacguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaaguguauguccaucauguguuacaaugc

SEQ ID NO: 1705 - RNA, 351 nt, artificial sequence
  synthetic construct
ggccauuagcauccuuaauguguacaauaucaaaggauccuggaugacguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaaguguauguccaucauguguuacaaugaaugguauauuuuuugguccagucuggacucuccuaauuuugcaaaguuuguauuuagcuucuucagcuguuauacggugaauggcaaaccuuccuuuuacaucauaaauaagacggc

SEQ ID NO: 1706 - RNA, 350 nt, artificial sequence
  synthetic construct
gauccuggaugacguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaaguguauguccaucauguguuacaaugaaugguauauuuuuugguccagucuggacucuccuaauuuugcaaaguuuguauuuagcuucuucagcuguuauacggugaauggcaaaccuuccuuuuacaucauaaauaagacggaaaaauucuccaguuuuuucaauggugauaacauc

SEQ ID NO: 1707 - RNA, 352 nt, artificial sequence
  synthetic construct
guaugaauacauuauguaaccuaguagcaaacacguggccauuagcauccuuaauguguacaauaucaaaggauccuggaugacguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaaguguauguccaucauguguuacaaugaaugguauauuuuuugguccagucuggacucuccuaauuuugcaaaguuuguauuuagcuucuucagcuguuauacggugaac

SEQ ID NO: 1708 - RNA, 352 nt, artificial sequence
  synthetic construct
gcaauuaugaauacauuauguaaccuaguagcaaacacguggccauuagcauccuuaauguguacaauaucaaaggauccuggaugacguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaaguguauguccaucauguguuacaaugaaugguauauuuuuugguccagucuggacucuccuaauuuugcaaaguuuguauuuagcuucuucagcuguuauacggc

SEQ ID NO: 1709 - RNA, 352 nt, artificial sequence
  synthetic construct
guaaccuaguagcaaacacguggccauuagcauccuuaauguguacaauaucaaaggauccuggaugacguucccuauugauuaccguaccaacacgacccaaauuucuaccuccaguaaucauacacaaguuaccagauucaaacuuaauguaguccaggauuuuagauguggcaauuuccaauugaauggugucauuuacuuugauguuggggucgggauaacgaaguguauguccaucauguguuacaaugaaugguauauuuuuugguccagucuggacucuccuaauuuugcaaaguuuguauuuagcuucuucagcuguuauacggugaauggcaaaccuuccuuc

SEQ ID NO: 1710 - RNA, 350 nt, artificial sequence
  synthetic construct
gguauacucuuacaauaccuccugaauaagcaucucuauggguagcaugauagauagaccugcgaccuaaaucauaugcuucuucgucugucaaaucccauuuguaaccugaaucgagcacaccaaaagcauagauggaaccugaaccuacacugaacacuuuuccagguguucuaagcccuucagaaucgacauaguaaaguugaggaccccucuugucccaaccagccaacaucauucccauagauaaccccauucccuuguaauuguaaaccauguuggccaucaacuuagaagcagcugcaacagaaauucuuucccuauuucugaguucauacauucuacauugc

SEQ ID NO: 1711 - RNA, 350 nt, artificial sequence
  synthetic construct
guaagcaccacccucuuuagacuucuccucuugguacuuauagugcaaaucguuacaaucauuauuaucaauaaguucccagccagucuccuucaugugguauacucuuacaauaccuccugaauaagcaucucuauggguagcaugauagauagaccugcgaccuaaaucauaugcuucuucgucugucaaaucccauuuguaaccugaaucgagcacaccaaaagcauagauggaaccugaaccuacacugaacacuuuuccagguguucuaagcccuucagaaucgacauaguaaaguugaggaccccucuugucccaaccagccaacaucauucccauagauaacc

SEQ ID NO: 1712 - RNA, 352 nt, artificial sequence
  synthetic construct
guauacucuuacaauaccuccugaauaagcaucucuauggguagcaugauagauagaccugcgaccuaaaucauaugcuucuucgucugucaaaucccauuuguaaccugaaucgagcacaccaaaagcauagauggaaccugaaccuacacugaacacuuuuccagguguucuaagcccuucagaaucgacauaguaaaguugaggaccccucuugucccaaccagccaacaucauucccauagauaaccccauucccuuguaauuguaaaccauguuggccaucaacuuagaagcagcugcaacagaaauucuuucccuauuucugaguucauacauucuacauugcuuc

SEQ ID NO: 1713 - RNA, 352 nt, artificial sequence
  synthetic construct
gauacucuuacaauaccuccugaauaagcaucucuauggguagcaugauagauagaccugcgaccuaaaucauaugcuucuucgucugucaaaucccauuuguaaccugaaucgagcacaccaaaagcauagauggaaccugaaccuacacugaacacuuuuccagguguucuaagcccuucagaaucgacauaguaaaguugaggaccccucuugucccaaccagccaacaucauucccauagauaaccccauucccuuguaauuguaaaccauguuggccaucaacuuagaagcagcugcaacagaaauucuuucccuauuucugaguucauacauucuacauugcuuac

SEQ ID NO: 1714 - RNA, 352 nt, artificial sequence
  synthetic construct
guuagcuaaaacucgaucccaguauacacaaucugcugcuccuccagccaaaguacccaacagaaaaucauuaauuucuacaauuuucuucauaguuugcgacccaaugaauugaccuccuguugcccuagagucuacagcgaguacuacacccccuuuguacaugaaccccagaguaguuguaccauggucaaaauuaauuuugauuucacguccacugucguccuuuguaaauuuggcaaaauuauugcuuugauuuagaaaagggggcacugcuaaguccaugccauuaucgaaguuccugcaauaucuggacaagccaucaucgugcauuaaucuuucauaaucuagc

SEQ ID NO: 1715 - RNA, 352 nt, artificial sequence
  synthetic construct
guuaucaauaaguucccagccagucuccuucaugugguauacucuuacaauaccuccugaauaagcaucucuauggguagcaugauagauagaccugcgaccuaaaucauaugcuucuucgucugucaaaucccauuuguaaccugaaucgagcacaccaaaagcauagauggaaccugaaccuacacugaacacuuuuccagguguucuaagcccuucagaaucgacauaguaaaguugaggaccccucuugucccaaccagccaacaucauucccauagauaaccccauucccuuguaauuguaaaccauguuggccaucaacuuagaagcagcugcaacagaaauucuc

SEQ ID NO: 1716 - RNA, 352 nt, artificial sequence
  synthetic construct
guuuagacuucuccucuugguacuuauagugcaaaucguuacaaucauuauuaucaauaaguucccagccagucuccuucaugugguauacucuuacaauaccuccugaauaagcaucucuauggguagcaugauagauagaccugcgaccuaaaucauaugcuucuucgucugucaaaucccauuuguaaccugaaucgagcacaccaaaagcauagauggaaccugaaccuacacugaacacuuuuccagguguucuaagcccuucagaaucgacauaguaaaguugaggaccccucuugucccaaccagccaacaucauucccauagauaaccccauucccuuguaauc

SEQ ID NO: 1717 - RNA, 352 nt, artificial sequence
  synthetic construct
guuauuaucaauaaguucccagccagucuccuucaugugguauacucuuacaauaccuccugaauaagcaucucuauggguagcaugauagauagaccugcgaccuaaaucauaugcuucuucgucugucaaaucccauuuguaaccugaaucgagcacaccaaaagcauagauggaaccugaaccuacacugaacacuuuuccagguguucuaagcccuucagaaucgacauaguaaaguugaggaccccucuugucccaaccagccaacaucauucccauagauaaccccauucccuuguaauuguaaaccauguuggccaucaacuuagaagcagcugcaacagaaauc

SEQ ID NO: 1718 - RNA, 351 nt, artificial sequence
  synthetic construct
gcuucaugugguauacucuuacaauaccuccugaauaagcaucucuauggguagcaugauagauagaccugcgaccuaaaucauaugcuucuucgucugucaaaucccauuuguaaccugaaucgagcacaccaaaagcauagauggaaccugaaccuacacugaacacuuuuccagguguucuaagcccuucagaaucgacauaguaaaguugaggaccccucuugucccaaccagccaacaucauucccauagauaaccccauucccuuguaauuguaaaccauguuggccaucaacuuagaagcagcugcaacagaaauucuuucccuauuucugaguucauacauuc

SEQ ID NO: 1719 - DNA, 149 bp, artificial sequence
  synthetic construct
aagtactgcgatcgcgttaacgctttatcacgataccttctaccacatatcactaacaacatcaacactcatcatctagactctcgacgacatccactcgtcactactctcacacgaccgattaactcctcatccacgcggccgcgagc

SEQ ID NO: 1720 - DNA, 150 bp, artificial sequence
  synthetic construct
aagtactgcgatcgcgttaacgctttatcacgataccttctaccacatatcactaacaacatcaacactcatcactctcgacgacatccactcgatcactactctcacacgaccgattaactcctcatccacgcggccgcctgcaggagc

SEQ ID NO: 1721 - DNA, 106 bp, artificial sequence
  synthetic construct
gcgtaacgtacgttacgcgtcgcgtcgatataattcgcgtcgttacggtattgcgctagaattcgcgtcgttatcgcgttcgcgatacggcgaaacgtactctaga

SEQ ID NO: 1722 - DNA, 640 bp, artificial sequence
  synthetic construct
gctttggatgatttctatgacaaaaacttccctgaatttataccgctaagaaccaaagttaaagaaatccttcaagaagaagacgaccttacggaaatcgtgcagctggtaggaaaagcttcattagctgaagctgataagattacattggaaatcgccaagctgttgaaagaagatttcctgcaacagaactcgtactcatcgtacgatagattctgtcccttctacaaaaccgtgggtatgttgaagaacatgattgggatgtacgcgtaacgtacgttacgcgtcgcgtcgatataattcgcgtcgttacggtattgcgctagaattcgcgtcgttatcgcgttcgcgatacggcgaaacgtactctagagtacatcccaatcatgttcttcaacatacccacggttttgtagaagggacagaatctatcgtacgatgagtacgagttctgttgcaggaaatcttctttcaacagcttggcgatttccaatgtaatcttatcagcttcagctaatgaagcttttcctaccagctgcacgatttccgtaaggtcgtcttcttcttgaaggatttctttaactttggttcttagcggtataaattcagggaagtttttgtcatagaaatcatccaaagc

SEQ ID NO: 1723 - RNA, 283 nt, artificial sequence
  synthetic construct
gggcgggugcuugucggucuucuugaagccgccgugguaguccucaaugaugggaucgaagauguccgcgaauacgguguacgauucagcgucgggggcguagauuccuacgccggagucgugguucuccaagccggauuggaugacaucaagaagagucgagccgaaagugggggucuucuuggucuucaaguugucgaagaucuccugggugaggugcuucuucagcagcgauuuggagucggaguccuugauuuucaugaaaccggauucaaguuugucc

SEQ ID NO: 1724 - RNA, 267 nt, artificial sequence
  synthetic construct
gcuuuggaugauuucuaugacaaaaacuucccugaauuuauaccgcuaagaaccaaaguuaaagaaauccuucaagaagaagacgaccuuacggaaaucgugcagcugguaggaaaagcuucauuagcugaagcugauaagauuacauuggaaaucgccaagcuguugaaagaagauuuccugcaacagaacucguacucaucguacgauagauucugucacuucuacaaaaccguggguauguugaagaacaugauugggauguac

What is claimed is:

1. A method of causing mortality or stunting in an insect, comprising contacting an insect with at least one recombinant double-stranded RNA (dsRNA) comprising at least one silencing element comprising an RNA strand identical or complementary to 21 or more contiguous nucleotides of an insect target gene sequence that has a DNA sequence of SEQ ID NO: 327, and the complement thereof, wherein said insect is Phylotreta spp., and wherein ingestion of said recombinant dsRNA by said insect results in mortality or stunting in said insect.

2. The method of claim 1, wherein said at least one silencing element comprises an RNA strand having a sequence identical or complementary to 21 or more contiguous nucleotides of SEQ ID NO: 1186.

3. The method of claim 1, wherein said insect is Phyllotreta cruciferae (canola flea beetle).

4. The method of claim 1, wherein said silencing element comprises an RNA strand having a sequence of SEQ ID NO: 1186.

5. The method of claim 1, wherein said recombinant dsRNA is provided in a microbial or plant cell that expresses said recombinant dsRNA, or in a microbial fermentation product, or is chemically synthesized.

6. The method of claim 1, wherein said at least one recombinant dsRNA is provided in a composition comprising said at least one recombinant dsRNA, wherein said composition is applied to a surface of said insect or to a surface of a seed or a plant in need of protection from infestation by said insect.

7. The method of claim 6, wherein said plant is:

(a) selected from an ornamental plant or a crop plant;

(b) a plant in the family Brassicaceae;

(c) a Brassica species selected from the group consisting of B. napus, B, juncea, B. carinata, B. rapa, B. oleracea, B. rupestris, B. septiceps, B. nigra, B. narinosa, B. perviridus, B. tournefortii, and B. fructiculosa;

(d) a Brassica plant selected from the group consisting of canola, rapeseed, turnips, and field mustard or turnip rape;

(e) selected from the group consisting of Glycine max, Linum usitatissimum, Zea mays, Carthamus tinctorius, Helianthus annuus, Nicotiana tabacum, Arabidopsis thaliana, Betholettia excelsa, Ricinus communis, Cocos nucifera, Coriandrum sativum, Gossypium spp., Arachis hypogaea, Simmondsia chinensis, Solanum

*tuberosum, Elaeis guineensis, Olea europaea, Oryza sativa, Cucurbita maxim, Hordeum vulgare,* and *Triticum aestivum*; or (f) a potato plant and said insect is *Epitrix cucumeris* (potato flea beetle).

8. The method of claim 6, wherein said contacting comprises:
    (a) oral delivery to said insect, non-oral delivery to said insect, or a combination of oral and non-oral delivery to said insect;
    (b) application of a composition comprising said recombinant dsRNA to a surface of said insect or to a surface of said plant infested by said insect;
    (c) providing said recombinant dsRNA in a composition that further comprises one or more components selected from the group consisting of a carrier agent, a surfactant, an organosilicone, a polynucleotide herbicidal molecule, a non-polynucleotide herbicidal molecule, a non-polynucleotide pesticide, a fungicide, a safener, a fertilizer, a micronutrient, an insect attractant, and an insect growth regulator;
    (d) providing said recombinant dsRNA in a composition that further comprises at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, a *Bacillus sphaericus* insecticidal protein, a bacterium that produces an insecticidal protein, an entomicidal bacterial species, *Lysinibacillus sphaericus* (*Bacillus sphaericus*), *Brevibacillus laterosporus* (*Bacillus laterosporus*), *Chromobacterium* species, *Chromobacterium subtsugae, Paenibacillus* species, *Paenibacillus lentimorbus,* and *Paenibacillus popilliae*; or
    (e) providing said recombinant dsRNA in a composition that is ingested by said insect.

9. An insecticidal composition comprising an insecticidally effective amount of a recombinant dsRNA molecule, wherein said recombinant dsRNA molecule comprises an RNA strand complementary to 21 or more contiguous nucleotides of a target gene of an insect that infests a plant, and the complement thereof, wherein said insect is *Phylotreta* spp., and wherein said target gene has a DNA sequence of SEQ ID NO: 327.

10. The insecticidal composition of claim 9, wherein said recombinant dsRNA molecule:
    (a) comprises at least one RNA strand having a sequence identical or complementary to 21 or more contiguous nucleotides of SEQ ID NO: 1186;
    (b) comprises dsRNA of at least 50 base pairs in length;
    (c) comprises blunt-ended dsRNA;
    (d) comprises dsRNA with an overhang at at least one terminus;
    (e) comprises dsRNA comprising at least one stem-loop;
    (f) comprises dsRNA that is chemically modified;
    (g) is a dsRNA comprising an RNA strand having a sequence identical or complementary to 21 or more contiguous nucleotides of SEQ ID NO: 1186;
    (h) is a dsRNA comprising an RNA strand having a sequence of SEQ ID NO: 1186; or
    (i) is provided in a microbial or plant cell that expresses said recombinant dsRNA, or in a microbial fermentation product; or is chemically synthesized.

11. The insecticidal composition of claim 9, wherein said insecticidal composition:
    (a) further comprises one or more components selected from the group consisting of a carrier agent, a surfactant, an organosilicone, a polynucleotide herbicidal molecule, a non-polynucleotide herbicidal molecule, a non-polynucleotide pesticide, a fungicide, a safener, a fertilizer, a micronutrient, an insect attractant, and an insect growth regulator;
    (b) further comprises at least one pesticidal agent selected from the group consisting of a patatin, a plant lectin, a phytoecdysteroid, a *Bacillus thuringiensis* insecticidal protein, a *Xenorhabdus* insecticidal protein, a *Photorhabdus* insecticidal protein, a *Bacillus laterosporous* insecticidal protein, a *Bacillus sphaericus* insecticidal protein, a bacterium that produces an insecticidal protein, an entomicidal bacterial species, *Lysinibacillus sphaericus* (*Bacillus sphaericus*), *Brevibacillus laterosporus* (*Bacillus laterosporus*), *Chromobacterium* species, *Chromobacterium subtsugae, Paenibacillus* species, *Paenibacillus lentimorbus,* and *Paenibacillus popilliae*; or
    (c) is in a form selected from the group consisting of a solid, liquid, powder, suspension, emulsion, spray, encapsulation, microbeads, carrier particulates, film, matrix, soil drench, insect diet or insect bait, and seed treatment.

12. A plant treated with the insecticidal composition of claim 9, or a plant grown from seed treated with the insecticidal composition of claim 9, wherein said plant exhibits improved resistance to said insect.

13. A recombinant DNA construct comprising a heterologous promoter operably linked to DNA encoding a dsRNA comprising a sequence identical or complementary to 21 or more contiguous nucleotides of SEQ ID NO: 1186, and the complement thereof.

14. A recombinant vector, plant chromosome or plastid, or transgenic plant cell comprising the recombinant DNA construct of claim 13.

15. A method of providing a plant having improved resistance to a *Phylotrera* spp. insect, comprising expressing in said plant the recombinant DNA construct of claim 13.

16. A plant having improved resistance to a *Phylotrera* spp. insect, provided by the method of claim 15, or fruit, seed, or propagatable parts of said plant.

* * * * *